(12) United States Patent
von Maltzahn et al.

(10) Patent No.: US 9,408,394 B2
(45) Date of Patent: Aug. 9, 2016

(54) ENDOPHYTES, ASSOCIATED COMPOSITIONS, AND METHODS OF USE THEREOF

(71) Applicant: Indigo Agriculture, Inc., Boston, MA (US)

(72) Inventors: Geoffrey von Maltzahn, Boston, MA (US); Richard Bailey Flavell, Thosand Oaks, CA (US); Gerardo V. Toledo, Belmont, MA (US); Jonathan W. Leff, Cambridge, MA (US); Phillip Samayoa, Cambridge, MA (US); Luis Miguel Marquez, Belmont, MA (US); David Morris Johnston, Cambridge, MA (US); Slavica Djonovic, Malden, MA (US); Yves Alain Millet, Newtonville, MA (US); Craig Sadowski, Somerville, MA (US); Jeffrey Lyford, Hollis, NH (US); Karen V. Ambrose, Cambridge, MA (US); Xuecheng Zhang, Brookline, MA (US)

(73) Assignee: Indigo Agriculture, Inc., Boston, MA (US)

( * ) Notice: Subject to any disclaimer, the term of this patent is extended or adjusted under 35 U.S.C. 154(b) by 0 days.

(21) Appl. No.: 14/879,910

(22) Filed: Oct. 9, 2015

(65) Prior Publication Data
US 2016/0021891 A1 Jan. 28, 2016

Related U.S. Application Data

(63) Continuation of application No. 14/752,829, filed on Jun. 26, 2015, which is a continuation-in-part of application No. PCT/US2014/044427, filed on Jun. 26, 2014.

(60) Provisional application No. 61/017,796, filed on Jun. 26, 2014, provisional application No. 62/017,809, filed on Jun. 26, 2014, provisional application No. 62/017,816, filed on Jun. 26, 2014, provisional application No. 62/017,813, filed on Jun. 26, 2014, provisional application No. 62/017,815, filed on Jun. 26, 2014, provisional application No. 62/017,818, filed on Jun. 26, 2014.

(51) Int. Cl.
*A01N 63/04* (2006.01)
*A01N 63/02* (2006.01)
*C05F 11/08* (2006.01)
*A01N 63/00* (2006.01)

(52) U.S. Cl.
CPC ............ *A01N 63/02* (2013.01); *A01N 63/00* (2013.01); *A01N 63/04* (2013.01); *C05F 11/08* (2013.01)

(58) Field of Classification Search
None
See application file for complete search history.

(56) References Cited

U.S. PATENT DOCUMENTS

| | | |
|---|---|---|
| 4,940,834 A | 7/1990 | Hurley et al. |
| 5,113,619 A | 5/1992 | Leps et al. |
| 5,229,291 A | 7/1993 | Nielsen et al. |
| 5,292,507 A | 3/1994 | Charley |
| 5,415,672 A | 5/1995 | Fahey et al. |
| 5,730,973 A | 3/1998 | Morales et al. |
| 5,919,447 A | 7/1999 | Marrone et al. |
| 5,994,117 A | 11/1999 | Bacon et al. |
| 6,072,107 A | 6/2000 | Latch et al. |
| 6,077,505 A | 6/2000 | Parke et al. |
| 6,337,431 B1 | 1/2002 | Tricoli et al. |
| 6,495,133 B1 | 12/2002 | Xue |
| 6,681,186 B1 | 1/2004 | Denisov et al. |
| 6,689,880 B2 | 2/2004 | Chen et al. |
| 6,823,623 B2 | 11/2004 | Minato et al. |
| 7,037,879 B2 | 5/2006 | Imada et al. |
| 7,084,331 B2 | 8/2006 | Isawa et al. |
| 7,335,816 B2 | 2/2008 | Kraus et al. |
| 7,341,868 B2 | 3/2008 | Chopade et al. |
| 7,485,451 B2 | 2/2009 | VanderGheynst et al. |
| 7,555,990 B2 | 7/2009 | Beaujot |
| 7,632,985 B2 | 12/2009 | Malven et al. |
| 7,763,420 B2 | 7/2010 | Stritzker et al. |
| 7,906,313 B2 | 3/2011 | Henson et al. |
| 7,977,550 B2 | 7/2011 | West et al. |
| 8,143,045 B2 | 3/2012 | Miasnikov et al. |
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 9,113,636 B2 | 8/2015 | von Maltzahn et al. |
| 2005/0072047 A1 | 4/2005 | Conkling et al. |
| 2006/0046246 A1 | 3/2006 | Zeng et al. |
| 2007/0028318 A1 | 2/2007 | Livore et al. |
| 2007/0055456 A1 | 3/2007 | Raftery et al. |

(Continued)

FOREIGN PATENT DOCUMENTS

| | | |
|---|---|---|
| CA | 1041788 | 11/1978 |
| CA | 1229497 | 11/1987 |

(Continued)

OTHER PUBLICATIONS

Fisher et al 1992, New Phytol. 120: 137-143.*

(Continued)

*Primary Examiner* — David H Kruse
(74) *Attorney, Agent, or Firm* — Fenwick & West LLP

(57) ABSTRACT

Materials and methods for improving plant traits and for providing plant benefits are provided. In some embodiments, the materials, and methods employing the same, can comprise endophytes.

20 Claims, 4 Drawing Sheets

(56) References Cited

U.S. PATENT DOCUMENTS

| | | | |
|---|---|---|---|
| 2007/0292953 | A1 | 12/2007 | Mankin et al. |
| 2008/0289060 | A1 | 11/2008 | De Beuckeleer et al. |
| 2009/0155214 | A1 | 6/2009 | Isawa et al. |
| 2010/0064392 | A1 | 3/2010 | Yang et al. |
| 2010/0095396 | A1 | 4/2010 | Voeste et al. |
| 2010/0205690 | A1* | 8/2010 | Blasing ............... C12N 15/8261 800/278 |
| 2010/0227357 | A1 | 9/2010 | Redman et al. |
| 2011/0182862 | A1 | 7/2011 | Green et al. |
| 2012/0108431 | A1 | 5/2012 | Williams et al. |
| 2012/0131696 | A1 | 5/2012 | Aayal et al. |
| 2012/0144533 | A1* | 6/2012 | Craven ................... A01N 63/04 800/300 |
| 2012/0178624 | A1 | 7/2012 | Kaminskyj et al. |
| 2012/0324599 | A1 | 12/2012 | Kerns et al. |
| 2013/0031673 | A1 | 1/2013 | Grandlic et al. |
| 2013/0071425 | A1 | 3/2013 | Vidal et al. |
| 2013/0079225 | A1 | 3/2013 | Smith et al. |
| 2013/0233501 | A1 | 9/2013 | Van Zyl et al. |
| 2014/0020136 | A1 | 1/2014 | Van Der Wolf et al. |
| 2014/0109249 | A1 | 4/2014 | Turner et al. |
| 2014/0115731 | A1 | 4/2014 | Turner et al. |
| 2015/0020239 | A1 | 1/2015 | von Maltzahn et al. |
| 2015/0126365 | A1 | 5/2015 | Sword |
| 2015/0230478 | A1 | 8/2015 | Vujanovic et al. |

FOREIGN PATENT DOCUMENTS

| | | |
|---|---|---|
| CA | 2562175 | 1/2013 |
| EP | 0192342 | 8/1986 |
| EP | 0223662 | 5/1987 |
| EP | 0378000 | 7/1990 |
| EP | 0494802 | 7/1992 |
| EP | 0818135 | 1/1998 |
| EP | 1935245 | 6/2008 |
| EP | 2676536 | 12/2013 |
| JP | 2009/072168 | 4/2009 |
| WO | WO 88/09114 | 1/1988 |
| WO | WO 94/16076 | 7/1994 |
| WO | WO 00/29607 | 5/2000 |
| WO | WO 01/83818 | 11/2001 |
| WO | WO 2005/003328 | 1/2005 |
| WO | WO 2007/021200 | 2/2007 |
| WO | WO 2007/107000 | 9/2007 |
| WO | WO 2008/103422 | 8/2008 |
| WO | WO 2010/109436 | 9/2010 |
| WO | WO 2010/115156 | 10/2010 |
| WO | WO 2011/082455 | 7/2011 |
| WO | WO 2011/112781 | 9/2011 |
| WO | WO 2011/117351 | 9/2011 |
| WO | WO 2012/034996 | 3/2012 |
| WO | WO 2013/029112 | 3/2013 |
| WO | WO 2013/090628 | 6/2013 |
| WO | WO 2013/122473 | 8/2013 |
| WO | WO 2013/177615 | 12/2013 |
| WO | WO 2013/190082 | 12/2013 |
| WO | WO 2014/046553 | 3/2014 |
| WO | WO 2014/121366 * | 8/2014 |
| WO | WO 2014/210372 | 12/2014 |
| WO | WO 2015/035099 | 3/2015 |
| WO | WO 2015/069938 | 5/2015 |
| WO | WO 2015/100431 | 7/2015 |
| WO | WO 2015/100432 | 7/2015 |
| WO | WO 2015/200852 | 12/2015 |
| WO | WO 2015/200902 | 12/2015 |

OTHER PUBLICATIONS de Lima Favaro et al 2012, PLoS ONE 7(6): e36826 (pp. 1-10).*
Gu et al 2007, Internat. J. of Systematic and Evolutionary Microbiology 57: 1995-1998.*
PCT Invitation to Pay Additional Fees, PCT Application No. PCT/US2015/038187, Oct. 14, 2015, 5 Pages.
PCT International Search Report and Written Opinion, PCT Application No. PCT/US2015/038110, Dec. 11, 2015, 36 Pages.
De Souza, J. J., et al., "Terpenoids from Endophytic Fungi," Molecules, 2011, pp. 10604-10618, vol. 16, No. 12.
Emerson, D., et al., Identifying and Characterizing Bacteria in an Era of Genomics and Proteomics, BioScience, 2008, pp. 925-936, vol. 58, No. 10.
Hinton, D. M., et al., "Enterobacter cloacae is an endophytic symbiont of corn," Mycopathologia, 1995, pp. 117-125, vol. 129.
Hubbard, M., et al., "Fungal Endophytes Improve Wheat Seed Germination Under Heat and Drought Stress," Botany, 2012, pp. 137-149, vol. 90.
Janda, J. M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.
Ma, Y., et al., "Plant Growth Promoting Rhizobacteria and Endophytes Accelerate Phytoremediation of Metalliferous Soils," Biotechnology Advances, 2011, pp. 248-258, vol. 29.
Mao, W., et al., "Seed Treatment with a Fungal or a Bacterial Antagonist for Reducing Corn Damping-off Caused by Species of Pythium and Fusarium," Plant Disease, 1997, pp. 450-454, vol. 81, No. 5.
Moe, L. A., "Amino Acids in the Rhizosphere: From Plants to Microbes," American Journal of Botany, 2013, pp. 1692-1705, vol. 100, No. 9.
Petti, C. A., " Detection and Identification of Microorganisms by Gene Amplification and Sequencing," Clinical Infectious Diseases, 2007, pp. 1108-1114, vol. 44.
Tokala, R. T., et al., "Novel Plant-Microbe Rhizosphere Interaction Involving Streptomyces Lydicus WYEC108 and the Pea Plant (*Pisum sativum*)," Applied and Environmental Microbiology, May 2002, pp. 2161-2171, vol. 68, No. 5.
You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4. (with English Abstract).
Invitation to Pay Additional Fees, PCT Application No. PCT/CA2013/000091, Mar. 27, 2013, 2 pages.
International Search Report and Written Opinion for PCT/CA2013/000091, Sep. 20, 2013, 17 Pages.
International Search Report and Written Opinion for PCT/EP2013/062976, Dec. 22, 2014, 9 Pages.
International Search Report, Application No. PCT/US2014/044427, Dec. 3, 2014, 9 Pages.
International Search Report and Written Opinion, Application No. PCT/US2014/054160, Dec. 9, 2014, 21 Pages.
Invitation to Pay Additional Fees, PCT Application No. PCT/US2014/064411, Feb. 5, 2015, 2 Pages.
International Search Report and Written Opinion, International Application No. PCT/US2014/064411, Mar. 27, 2015, 15 Pages.
PCT Invitation to Pay Additional Fees, PCT Application No. PCT/US2014/072399, Apr. 14, 2015, 2 Pages.
International Search Report and Written Opinion, International Application No. PCT/US2014/072399, Jun. 26, 2015, 22 Pages.
Invitation to Pay Additional Fees, PCT Application No. PCT/US2014/072400, Apr. 16, 2015, 6 Pages.
International Search Report and Written Opinion, Application No. PCT/US2014/072400, Jul. 8, 2015, 38 Pages.
Abarenkov, K., et al., "PlutoF—A Web Based Workbench for Ecological and Taxonomic Research, with an Online Implementation for Fungal ITS Sequences," Evol Bioinform Online, 2010, pp. 189-196, vol. 6.
Abarenkov, K., et al., "The UNITE Database for Molecular Identification of Fungi—Recent Updates and Future Perspectives," New Phytol., 2010, pp. 281-285, vol. 186.
Ahmad, F., et al., "Screening of Free-Living Rhizospheric Bacteria for Their Multiple Plant Growth Promoting Activities," Microbiol Res., 2008, pp. 173-181, vol. 163.
Amann, R., et al., "The Identification of Microorganisms by Fluorescence in Situ Hybridisation," Curr Opin Biotechnol., 2001, pp. 231-236, vol. 12.
Apel, K., et al., "Reactive Oxygen Species: Metabolism, Oxidative Stress, and Signal Transduction," Annu Rev Plant Biol., 2004, pp. 373-399, vol. 55.

(56) References Cited

OTHER PUBLICATIONS

Bacon, C.W., et al., "Isolation, In Planta Detection, and Uses of Endophytic Bacteria for Plant Protection," Manual of Environmental Microbiology, 2007, pp. 638-647.
Baker, K.F., et al., "Dynamics of Seed Transmission of Plant Pathogens," Annu Rev Phytopathol., 1966, pp. 311-334,vol. 4.
Block, C.C., et al., "Seed Transmission of Pantoea stewartii in Field and Sweet Corn," Plant Disease, 1998, pp. 775-780, vol. 82.
Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.
Brodie, E.L., et al., "Uncultured Bacterium Clone BANW722 16S Ribosomal RNA Gene, Partial Sequence," NCBI GenBank Accession No. DQ264636, Submitted Oct. 25, 2005.
Bulgarelli, D., et al., "Structure and Functions of the Bacterial Microbiota of Plants," Annu Rev Plant Biol., 2013, pp. 807-838, vol. 64.
Caporaso, J.G., et al., "Ultra-High-Throughput Microbial Community Analysis on the Illumina HiSeq and MiSeq Platforms," ISME J., 2012, pp. 1621-1624, vol. 6.
Castillo, D., et al., "Fungal Entomopathogenic Endophytes: Negative Effects on Cotton Aphid Reproduction in Greenhouse and Field Conditions," Power Point Presentation dated Mar. 23, 2013.
Castillo, D., et al., "Fungal Endophytes: Plant Protective Agents Against Herbivores," Power Point Presentation dated Aug. 4, 2013.
Cavalier-Smith, T., "A Revised Six-Kingdom System of Life," Biol Rev Camb Philos Soc., 1998, pp. 203-266, vol. 73.
Cha, C., et al., "Production of Acyl-Homoserine Lactone Quorum-Sensing Signals by Gram-Negative Plant Associated Bacteria," Mol Plant Microbe Interact., 1998, pp. 1119-1129, vol. 11, No. 11.
Chernin, L.S., et al., "Chitinolytic Activity in Chromobacterium violaceum: Substrate Analysis and Regulation by Quorum Sensing," J Bacteriol., 1998, pp. 4435-4441, vol. 180, No. 17.
Clark, E.M., et al., "Improved Histochemical Techniques for the Detection of Acremonium coenophilum in Tall Fescue and Methods of in vitro Culture of the Fungus," J. Microbiol Methods, 1983, pp. 149-155, vol. 1.
Clough, S.J., et al., "Floral Dip: A Simplified Method for Agrobacterium-mediated Transformation of Arabidopsis thaliana," Plant J., 1998, pp. 735-743, vol. 16, No. 6.
Compant, S., et al., "Endophytes of Grapevines Flowers, Berries, and Seeds: Identification of Cultivable Bacteria, Comparison with Other Plant Parts, and Visualization of Niches of Colonization," Microbial Ecology, 2011, pp. 188-197, vol. 62.
Coombs, J.T., et al., "Isolation and Identification of Actinobacteria from Surface-Sterilized Wheat Roots," Applied and Environmental Microbiology, 2003, pp. 5603-5608, vol. 69, No. 9.
Conn, V.M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.
Cox, C.D., "Deferration of Laboratory Media and Assays for Ferric and Ferrous Ions," Methods Enzymol., 1994, pp. 315-329, vol. 235.
Craine, J.M., et al., "Global Diversity of Drought Tolerance and Grassland Climate-Change Resilience," Nature Climate Change, 2013, pp. 63-67, vol. 3.
Dalal, J.M., et al., "Utilization of Endophytic Microbes for Induction of Systemic Resistance (ISR) in Soybean (*Glycine max* (L) Merril) Against Challenge Inoculation with R. solani," Journal of Applied Science and Research, 2014, pp. 70-84, vol. 2, No. 5.
Danhorn, T., et al., "Biofilm Formation by Plant-Associated Bacteria," Annu Rev Microbiol., 2007, pp. 401-422, vol. 61.
Daniels, R., et al., "Quorum Signal Molecules as Biosurfactants Affecting Swarming in Rhizobium etli," PNAS, 2006, pp. 14965-14970, vol. 103, No. 40.
De Freitas, J.R., et al., "Phosphate-Solubilizing Rhizobacteria Enhance the Growth and Yield but not Phosphorus Uptake of Canola (*Brassica napus* L.)," Biol Fertil Soils, 1997, pp. 358-364, vol. 24.
De Melo Pereira, G. V., et al. "A Multiphasic Approach for the Identification of Endophytic Bacterial in Strawberry Fruit and their Potential for Plant Growth Promotion," Microbial Ecology, 2012, pp. 405-417, vol. 63, No. 2.
Dennis, C., et al., "Antagonistic Properties of Species Groups of Trichoderma," Trans Brit Mycol Soc, 1971, pp. 25-39, vol. 57, No. 1.
Djordjevic, D., et al., "Microtiter Plate Assay for Assessment of Listeria monocytogenes Biofilm Formation," Annl Environ Microbiol., 2002, pp. 2950-2958, vol. 68, No. 6.
Don, R.H., et al., "Properties of Six Pesticide Degradation Plasmids Isolated From Alcaligenes Paradoxus and Alcaligenes eutrophus," J Bacteriol., 1981, pp. 681-686, vol. 145, No. 2.
Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012.
Eberhard, A., et al., "Structural Identification of Autoinducer of Photobacterium fischeri Luciferase," Biochem., 1981, pp. 2444-2449, vol. 20.
Edgar, R.C., "Search and Clustering Orders of Magnitude Faster than BLAST," Bioinformatics, 2010, pp. 2460-2461, vol. 26, No. 19.
Edgar, R.C., "UPARSE: Highly Accurate OTU Sequences From Microbial Amplicon Reads," Nat Methods, 2013, pp. 996-998, vol. 10, No. 10.
Ek-Ramos, M.J., "Ecology, Distribution and Benefits of Fungal Endophytes Isolated from Cultivated Cotton (*Gossypium hirsutum*) in Texas," Power Point Presentation dated Nov. 7, 2012.
Ek-Ramos, M.J., et al., "Spatial and Temporal Variation in Fungal Endophyte Communities Isolated from Cultivated Cotton (*Gossypium hirsutum*)," PLoS ONE, 2013, vol. 8, No. 6, 13 Pages.
Ek-Ramos, M.J., et al., "Spatial and Temporal Variation in Fungal Endophyte Communities Isolated from Cultivated Cotton (*Gossypium hirsutum*)," Power Point Presentation dated Jan. 7, 2013.
El-Shanshoury, A.R., "Growth Promotion of Wheat Seedlings by Streptomyces atroolivaceus," Journal of Agronomy and Crop Science, 1989, pp. 109-114, vol. 163.
Endre, G., et al., "A Receptor Kinase Gene Regulating Symbiotic Nodule Development," Nature, 2002, pp. 962-966, vol. 417.
Faria, D.C., et al., "Endophytic Bacteria Isolated from Orchid and Their Potential to Promote Plant Growth," World J Microbiol Biotechnol., 2013, pp. 217-221, vol. 29.
Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.
Fiehn, O., et al., "Metabolite Profiling for Plant Functional Genomics," Nature Biotechnol., 2000, pp. 1157-1161, vol. 8.
Fierer, N., et al., "Cross-Biome Metagenomic Analyses of Soil Microbial Communities and Their Functional Attributes," Proc Natl Aced Sci USA, 2012, pp. 21390-21395, vol. 109, No. 52.
Fincher, G.B., "Molecular and Cellular Biology Associated with Endosperm Mobilization in Germinating Cereal Grains," Annu Rev Plant Phvsiol Plant Mol Biol., 1989, pp. 305-346, vol. 40.
Fisher, P.R., et al., "Isolation and Characterization of the Pesticide-Degrading Plasmid pJP1 from Alcaligenes paradoxus," J Bacteriol., 1978, pp. 798-804, vol. 135, No. 3.
Franco, C., et al., "Actinobacterial Endophytes for Improved Crop Performance," Australasian Plant Pathology, 2007, pp. 524-531, vol. 36.
Fulthorpe, R.R., et al., "Distantly Sampled Soils Carry Few Species in Common," ISME J., 2008, pp. 901-910, vol. 2.
Gantner, S., et al., "Novel Primers for 16S rRNA-based Archaeal Community Analyses in Environmental Samples," J Microbiol Methods, 2011, pp. 12-18, vol. 84.
Gao, Z., et al., "Quantitation of Major Human Cutaneous Bacterial and Fungal Populations," J Clin Microbiol., 2010, pp. 3575-3581, vol. 48, No. 10.
Gasser, I., et al., "Ecology and Characterization of Polyhydroxyalkanoate-Producing Microorganisms on and in Plants," FEMS Microbiol Ecol., 2010, pp. 142-150, vol. 70.
Gavrish, E, et al., "*Lentzea* sp. MS6 16S Ribosomal RNA Gene, Partial Sequence," NCBI GenBank Accession No. EF599958. Submitted May 9, 2007.

(56) References Cited

OTHER PUBLICATIONS

Gilmour, S.J., et al., "Overexpression of the Arabidopsis CBF3 Transcriptional Activator Mimics Multiple Biochemical Changes Associated with Cold Acclimation," Plant Physiol., 2000, pp. 1854-1865, vol. 124.
Gitaitis, R., et al., "The Epidemiology and Management of Seedborne Bacterial Diseases," Annu Rev Phytopathol., 2007, pp. 371-397, vol. 45.
Haake, V., et al., "Transcription Factor CBF4 is a Regulator of Drought Adaptation in Arabidopsis," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Hallman, J., et al., "Bacterial Endophytes in Agricultural Crops," Canadian J Microbiol., 1997, pp. 895-914, vol. 43.
Hardegree, S.P. et al., "Effect of Polyethylene Glycol Exclusion on the Water Potential of Solution-Saturated Filter Paper," Plant Physiol., 1990, pp. 462-466, vol. 92.
Hardoim, P.R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.
Hardoim, P.R., et al., "Dynamics of Seed-Borne Rice Endophytes on Early Plant Growth Stages," PLoS ONE, 2012, vol. 7, No. 2, 13 Pages.
Hepler, P.K., et al., "Polarized Cell Growth in Higher Plants," Annu Rev Cell Dev Biol., 2001, pp. 159-187, vol. 17.
Hiatt, E.E., et al., "Tall Fescue Endophyte Detection: Commerical Immunoblot Test Kit Compared with Microscopic Analysis," Crop Science, 1999, pp. 796-799, vol. 39.
Hibbett, D.S., et al., "A Higher-Level Phylogenetic Classification of the Fungi," Mycol Res., 2007, pp. 509-547 vol. 111.
Hill, N. S., et al., "Endophyte Survival during Seed Storage: Endophyte-Host Interactions and Heritability," Crop Sci., 2009, pp. 1425-1430, vol. 49.
Hill N.S., et al., "Endophyte Survival during Seed Storage: Endophyte-Host Interactions and Heritability," PowerPoint, Dept. Crop Soil Sciences, University of Georgia, Nov. 16, 2012, 3 Pages.
Hung, P.Q., et al., "Isolation and Characterization of Endophytic Bacteria in Soybean (*Glycine* Sp.)," Omonrice, 2004, pp. 92-101, vol. 12.
Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.
Ikeda, S., et al., "The Genotype of the Calcium/Calmodulin-Dependent Protein Kinase Gene (CCaMK) Determines Bacterial Community Diversity in Rice Roots Under Paddy and Upland Field Conditions," Applied and Environmental Microbiology, 2011, pp. 4399-4405, vol. 77, No. 13.
Imoto, K., et al., "Comprehensive Approach to Genes Involved in Cell Wall Modifications in Arabidopsis thaliana," Plant Mol Biol., 2005, pp. 177-192, vol. 58.
Johnston-Monje, D., et al., "Conservation and Diversity of Seed Associated Endophytes in *Zea* Across Boundaries of Evolution, Ethnography and Ecology," PLoS ONE, 2011, vol. 6, No. 6, 22 Pages.
Johnston-Monje, D., et al., "Plant and Endophyte Relationships: Nutrient Management," Comprehensive Biotechnol., 2011, pp. 713-727, vol. 4.
Johnston-Monje, D., "Microbial Ecology of Endophytic Bacteria in *Zea* Species as Influenced by Plant Genotype, Seed Origin, and Soil Environment," Thesis, University of Guelph, 2011, 230 Pages.
Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.
Kaga, H., et al., "Rice Seeds as Sources of Endophytic Bacteria," Microbes Environ., 2009, pp. 154-162, vol. 24, No. 2.
Kalns, L., et al., "The Effects of Cotton Fungal Endophytes in the Field on Arthropod Community Structure," Power Point Presentation dated Jan. 7, 2013.

Kang, B.H., et al., "Members of the Arabidopsis Dynamin-Like Gene Family, ADL1, are Essential for Plant Cytokinesis and Polarized Cell Growth," Plant Cell, 2003, pp. 899-913, vol. 15.
Kasana, R.C., et al., "A Rapid and Easy Method for the Detection of Microbial Cellulases on Agar Plates Using Gram's Iodine," Curr Microbiol., 2008, pp. 503-507, vol. 57.
Kruger, M., et al., "DNA-Based Species Level Detection of Glomeromycota: One PCR Primer Set for All Arbuscular Mycorrhizal Fungi," New Phvtol., 2009, pp. 212-223, vol. 183.
Kuklinsky-Sobral, J., et al., "Isolation and Characterization of Endophytic Bacteria from Soybean (*Glycine max*) Grown in Soil Treated with Glyphosate Herbicide," Plant and Soil, 2005, pp. 91-99, vol. 273.
Lanver, D., et al., "Sho1 and Msb2-Related Proteins Regulate Appressorium Development in the Smut Fungus *Ustilago aydis*," Plant Cell, 2010, pp. 2085-2101, vol. 22.
Laus, M.C., et al., "Role of Cellulose Fibrils and Exopolysaccharides of Rhizobium leguminosarum in Attachment to and Infection of Vicia sativa Root Hairs," Mol Plant Microbe Interact., 2005, pp. 533-538, vol. 18, No. 6.
Leonard, C.A., et al., "Random Mutagenesis of the Aspergillus oryzae Genome Results in Fungal Antibacterial Activity," Int J Microbiol., 2013, vol. 2013, Article ID 901697, 6 Pages.
Li, H.M., et al., "Expression of a Novel Chitinase by the Fungal Endophyte in Poa ampla," Mycologia, 2004, pp. 526-536, vol. 96, No. 3.
Liu, M., et al., "A Novel Screening Method for Isolating Exopolysaccharide-Deficient Mutants," Appl Environ Microbiol., 1998, pp. 4600-4602, vol. 64, No. 11.
Liu, Y., et al., "Investigation on Diversity and Population Succession Dynamics of Endophytic Bacteria from Seeds of Maize (*Zea mays* L., Nongda108) at Different Growth Stages," Ann Microbiol., 2013, pp. 71-79, vol. 63.
Liu, D., et al., "Osmotin Overexpression in Potato Delays Development of Disease Symptoms," Proc Natl Acad Sci USA, 1994, pp. 1888-1892, vol. 91.
Liu, Y., et al., "Study on Diversity of Endophytic Bacterial Communities in Seeds of Hybrid Maize and their Parental Lines," Arch Microbiol., 2012, pp. 1001-1012, vol. 194.
Long, H.H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.
Lopez-Lopez, A., et al., "Phaseolus vulgaris Seed-Borne Endophytic Community with Novel Bacterial Species such as *Rhizobium endophyticum* sp. nov.," Systematic Appl Microbiol., 2010, pp. 322-327, vol. 33.
Lorck, H., "Production of Hydrocyanic Acid by Bacteria," Physiol Plant, 1948, pp. 142-146, vol. 1.
Lugtenberg, B., et al., "Plant-Growth-Promoting Rhizobacteria," Ann. Rev. Microbiol., 2009, pp. 541-556, vol. 63.
Lundberg, D.S., et al., "Defining the Core Arabidopsis thaliana Root Microbiome," Nature, 2012, pp. 86-90, vol. 488, No. 7409.
Lundberg, D.S., et al., "Practical Innovations for High-Throughput Amplicon Sequencing," Nat Methods, 2013, pp. 999-1002, vol. 10, No. 10.
Madi, L. et al., "Aggregation in Azospirillum brasilense Cd: Conditions and Factors Involved in Cell-to-Cell Adhesion," Plant Soil, 1989, pp. 89-98, vol. 115.
Mannisto, M.K., et al., "Characterization of Psychrotolerant Heterotrophic Bacteria From Finnish Lapland," Svst Appl Microbiol., 2006, pp. 229-243, vol. 29.
Mano, H., et al., "Culturable Surface and Endophytic Bacterial Flora of the Maturing Seeds of Rice Plants (*Oryza sativa*) Cultivated in a Paddy Field," Microbes Environ., 2006, vol. 21, No. 2.
Manter, D.K., et al., "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.
Marasco, R., et al., "A Drought Resistance-Promoting Microbiome is Selected by Root System Under Desert Farming," PLoS ONE, 2012, vol. 7, No. 10, 14 Pages.

(56) References Cited

OTHER PUBLICATIONS

Marquez, L.M., et al., "A Virus in a Fungus in a Plant: Three-Way Symbiosis Required for Thermal Tolerance," Science, 2007, pp. 513-515, vol. 315.

Mastretta, C., et al., "Endophytic Bacteria from Seeds of Nicotiana Tabacum Can Reduce Cadmium Phytotoxicity," Intl J Phytoremediation, 2009, pp. 251-267, vol. 11.

Mateos, P.F., et al., "Cell-Associated Pectinolytic and Cellulolytic Enzymes in Rhizobium leguminosarum biovar trifolii," Appl Environ Microbiol., 1992, pp. 816-1822, vol. 58, No. 6.

McDonald, D., et al., "An Improved Greengenes Taxonomy with Explicit Ranks for Ecological and Evolutionary Analyses of Bacteria and Archaea," ISME J., 2012, pp. 610-8, vol. 6.

McGuire, K.L., et al., "Digging the New York City Skyline: Soil Fungal Communities in Green Roofs and City Parks," PloS One, 2013, vol. 8, No. 3, 13 Pages.

Medina, P., et al., "Rapid Identification of Gelatin and Casein Hydrolysis Using TCA," J Microbiol Methods, 2007, pp. 391-393, vol. 69.

Mehnaz, S., et al., "Growth Promoting Effects of Corn (Zea mays) Bacterial Isolates Under Greenhouse and Field Conditions," Soil Biology and Biochemistry, 2010, pp. 1848-1856, vol. 42.

Michel, B.E., et al., "The Osmotic Potential of Polyethylene Glycol 6000," Plant Physiol., 1973, pp. 914-916, vol. 51.

Mohiddin, F.A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.

Mousa, W.K., et al., "The Diversity of Anti-Microbial Secondary Metabolites Produced by Fungal Endophytes: An Interdisciplinary Perspective," Front Microbiol., 2013, vol. 4, No. 65, 18 Pages.

Mundt, J.O., et al., "Bacteria Within Ovules and Seeds," Appl Environ Microbiol., 1976, pp. 694-698, vol. 32, No. 5.

Naveed, M., "Maize Endophytes—Diversity, Functionality and Application Potential," University of Natural Resources and Life Sciences, 2013, pp. 1-266 and 81-87; Tables 1-3; Figure 2.

Nejad, P. et al., "Endophytic Bacteria Induce Growth Promotion and Wilt Disease Suppression in Oilseed Rape and Tomato," Biological Control, 2000, pp. 208-215, vol. 18.

Neslon, E.B., "Microbial Dynamics and Interactions in the Spermosphere," Ann. Rev. Phytopathol., 2004, pp. 271-309, vol. 42.

Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.

Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.

Okunishi, S., et al., "Bacterial Flora of Endophytes in the Maturing Seeds of Cultivated Rice (Oryza sativa)," Microbes and Environment, 2005, pp. 168-177, vol. 20, No. 3.

Partida-Martinez, L.P., et al., "The Microbe-Free Plant: Fact or Artifact?" Front Plant Sci., 2011, vol. 2, No. 100, 16 Pages.

Pearson, W.R., et al., "Rapid and Sensitive Sequence Comparison With FASTP and FASTA," Methods Enzymol., 2011, pp. 63-98, vol. 183.

Pedraza, R.O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.

Perez-Fernandez, M.A., et al., "Simulation of Germination of Pioneer Species Along an Experimental Drought Gradient," J Environ Biol., 2006, pp. 669-685, vol. 27, No. 4.

Perez-Miranda, S., et al., "O-CAS, A Fast and Universal Method for Siderophore Detection," J Microbiol Methods, 2007, pp. 127-131, vol. 70.

Phalip, V., et al., "A Method for Screening Diacetyl and Acetoin-Producing Bacteria on Agar Plates," J Basic Microbiol., 1994, pp. 277-280, vol. 34.

Philippot, L., et al., "Going Back to the Roots: The Microbial Ecology of the Rhizosphere," Nat Rev Microbiol., Nov. 2013, pp. 789-799, vol. 11.

Pillay, V.K., et al., "Inoculum Density, Temperature, and Genotype Effects on in vitro Growth Promotion and Epiphytic and Endophytic Colonization of Tomato (Lycopersicon esculentum L.) Seedlings Inoculated with a Pseudomonad Bacterium," Can J Microbiol., 1997, pp. 354-361, vol. 43.

Powell, W.A., et al., "Evidence of Endophytic Beauveria Bassiana in Seed-Treated Tomato Plants Acting as a Systemic Entomopathogen to Larval Helicoverpa zea (Lepidoptera: Noctuidae)," J. Entomol. Sci., 2009, pp. 391-396, vol. 44, No. 4.

Quadt-Hallmann, A., et al., "Bacterial Endophytes in Cotton: Mechanisms of Entering the Plant," Can J Microbiol., 1997, pp. 577-582, vol. 43.

R Core Team, "R: A Language and Environment for Statistical Computing," R Foundation for Statistical Computing, Vienna, Austria, May 2013, ISBN: 3-900051-07-0. Available online at http://www.R-25 project.org/, 3604 Pages.

Reiter, B., et al., "Response of Endophytic Bacterial Communities in Potato Plants to Infection with Erwinia carotovora subsp. atroseptica," Appl Environ Microbiol., 2001, pp. 2261-2268, vol. 68, No. 5.

Rodriguez, H., et al., "Expression of a Mineral Phosphate Solubilizing Gene From Erwinia herbicola in Two Rhizobacterial Strains," J Biotechnol., 2001, pp. 155-161, vol. 84.

Rodriguez, R.J., et al., "Stress Tolerance in Plants via Habitat-Adapted Symbiosis," ISME J., 2008, pp. 404-416, vol. 2.

Rodriguez-Navarro, D., et al., "Soybean Interactions with Soil Microbes, Agronomical and Molecular Aspects," Agronomy for Sustainable Development, 2011, pp. 173-190, vol. 31, No. 1.

Roessner, U., et al., "Metabolic Profiling Allows Comprehensive Phenotyping of Genetically or Environmentally Modified Plant Systems," Plant Cell, 2001, pp. 11-29, vol. 13.

Rosado, A.S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.

Rosenblueth, A., et al., "Seed Bacterial Endophytes: Common Genera, Seed-to-Seed Variability and Their Possible Role in Plants," Acta Hort., 2012, pp. 39-48, vol. 938.

Rosenblueth, M., et al., "Bacterial Endophytes and Their Interactions With Host," Molecular Plant-Microbe Interactions, 2006, pp. 827-837, vol. 19, No. 8.

Ross, P.L., et al., "Multiplexed Protein Quantitation in Saccharomyces cerevisiae Using Amine-Reactive Isobaric Tagging Reagents," Mol Cell Proteomics, 2004, pp. 1154-1169, vol. 3, No. 12.

Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.

Samac, D.A., et al., "Recent Advances in Legume-Microbe Interactions: Recognition, Defense Response, and Symbiosis from a Genomic Perspective," Plant Physiol., 2007, pp. 582-587, vol. 144.

Sardi, P., et al., "Isolation of Endophytic Streptomyces Strains from Surface Sterilized Roots," Applied and Environmental Microbiology, 1992, pp. 2691-2693, vol. 58, No. 8.

Sarwar, M., et al., "Tryptophan Dependent Biosynthesis of Auxins in Soil," Plant Soil, 1992, pp. 207-215, vol. 147.

Schmieder, R., et al., "Quality Control and Preprocessing of Metagenomic Datasets," Bioinformatics, 2011, pp. 863-864, vol. 27, No. 6.

Schoch, C.L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.

Schwyn, B. et al., "Universal Chemical Assay for the Detection and Determination of Siderophores," Analytical Biochemistry, 1987, pp. 47-56, vol. 160.

Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.

(56) References Cited

OTHER PUBLICATIONS

Singh, AK, et al., "Uncultured *Actinomyces* sp. Clone EMLACT 80 IV (New) 16S Ribosomal RNA Gene, Partial Sequence," NCBI GenBank Accession No. JQ285908. Submitted Dec. 13, 2011.
Soares, M.M.C.N, et al., "Screening of Bacterial Strains for Pectinolytic Activity: Characterization of the Polygalacturonase Produced by *Bacillus* SP," Revista de Microbiolgia, 1999, pp. 299-303, vol. 30.
Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.
Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.
Staudt, A.K., et al., "Variations in Exopolysaccharide Production by Rhizobium tropici," Arch Microbiol., 2012, pp. 197-206, vol. 194.
Strobel, G.A., "Endophytes as Sources of Bioactive Products," Microbes and Infection, 2003, pp. 535-544, vol. 5.
Sturz, A.V., et al., "Weeds as a Source of Plant Growth Promoting Rhizobacteria in Agricultural Soils," Can J Microbiol., 2001, pp. 1013-1024, vol. 47, No. 11.
Surette, M. A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.
Suto, M., et al., "Endophytes as Producers of Xylanase," J Biosci Bioeng., 2002, pp. 88-90, vol. 93, No. 1.
Sword, G., "Manipulating Fungal Endophytes to Protect Plants from Insects and Nematodes," Power Point Presentation dated Aug. 7, 2013.
Sword, G., et al., "Manipulating Fungal Endophytes for the Protection of Cotton in the Field," Power Point Presentation dated Jan. 7, 2013.
Sword, G., et al., "Field Trials of Potentially Beneficial Fungal Endophytes in Cotton," Power Point Presentation dated Jan. 7, 2013.
Sword, G., "Fungal Endophytes to Protect Cotton from Insects and Nematodes," Power Point Presentation dated Dec. 7, 2012.
Sword, G., "Natural Enemies—The Forgotten Basis of IPM?," Power Point Presentation dated Sep. 6, 2013.
Taylor, A.G., et al., "Concepts and Technologies of Selected Seed Treatments," Annu. Rev. Phytopathol., 1990, pp. 321-339, vol. 28.
Teather, R.M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.
Theis, K.R., et al., "Uncultured Bacterium Clone GM2GI8201A64RC 16S Ribosomal RNA Gene, Partial Sequence," NCBI GenBank Accession No. JX051943, Submitted May 14, 2012.
Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.
Thomashow, M.F., "So What's New in the Field of Plant Cold Acclimation? Lots!," Plant Physiol., 2001, pp. 89-93, vol. 125.
Trotel-Aziz, P., et al., "Characterization of New Bacterial Biocontrol Agents *Acinetobacter, Bacillus, Pantoea* and *Pseudomonas* spp. Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed Arabidopsis thaliana," Plant Biol., 2013, pp. 971-981, vol. 15.
Usadel, B., et al., "The Plant Transcriptome—From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C.U., et al., "Endophytic Establishment as an Unintended Consequence of Biocontrol with Fungal Entomopathogens," Power Point Presentation dated Jan. 7, 2013.
Van Der Lelie, D., et al., "Poplar and its Bacterial Endophytes: Coexistence and Harmony," Critical Rev Plant Sci., 2009, pp. 346-358, vol. 28.

Vining, K., et al., "Methylome Reorganization During in vitro Dedifferentiation and Regeneration of Populus trichocarpa," BMC Plant Biol., 2013, vol. 13, No. 92, 15 Pages.
Virule, E., et al., "Pseudomonas thiveralensis Strain IEHa 16S Ribosomal RNA Fene, Partial Sequence," NCBI GenBank Accession No. GQ169380.1, Submitted May 15, 2009.
Waller, F. et al., "The Endophytic Fungus *Piriformospora indica* Reprograms Barley to Salt-Stress Tolerance, Disease Resistance, and Higher Yield," PNAS, 2005, pp. 13386-13391, vol. 102, No. 38.
Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.
Wang, Q., et al., "Naive Bayesian Classifier for Rapid Assignment of rRNA Sequences into the New Bacterial Taxonomy," Appl. Environ. Microbiol., 2007, pp. 5261-5267, vol. 73, No. 16.
Weaver, P.F., et al., "Characterization of Rhodopseudomonas capsulata," Arch Microbiol., 1975, pp. 207-216, vol. 105.
Welty, R.E., et al., "Influence of Moisture Content, Temperature, and Length of Storage on Seed Germination and Survival of Endophytic Fungi in Seeds of Tall Fescue and Perennial Ryegrass," Phytopathyol., 1987, pp. 893-900, vol. 77, No. 6.
White, J.F., et al., "A Proposed Mechanism for Nitrogen Acquisition by Grass Seedlings Through Oxidation of Symbiotic Bacteria," Symbiosis, 2012, pp. 161-171, vol. 57.
Wiegand, I., et al., "Agar and Broth Dilution Methods to Determine the Minimal Inhibitory Concentration (MIC) of Antimicrobial Substances," Nature Protocols, 2008, pp. 163-175, vol. 3, No. 2.
Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings," World J Microbiol Biotechnol., 2014, pp. 835-845, vol. 30.
Xu, Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.
Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.
Yezerski, A., et al., "The Effects of the Presence of Stored Product Pests on the Microfauna of a Flour Community," Journal of Applied Microbiology, 2005, pp. 507-515, vol. 98.
Zuccaro, A., et al., "Endophytic Life Strategies Decoded by Genome and Transcriptome Analyses of the Mutualistic Root Symbiont Piriformospora indica," PLOS Pathogens, 2011, vol. 7, No. 10, e1002290.
Zhou, W., et al., "Effects of the Fungal Endophyte *Paecilomyces* sp. in Cotton on the Roo-Knot Nematode Meloidogyne incognita," poster dated Jan. 7, 2013.
Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.
Zuniga, A., et al., "Quorum Sensing and Indole-3-Acetic Acid Degradation Play a Role in Colonization and Plant Growth Promotion of Arabidopsis thaliana by Burkholderia phytofirmans PsJN," Mol Plant Microbe Interact., 2013, pp., 546-553, vol. 26, No. 5.
Li, Q., "Agrobacterium tumefaciens Strain TA-AT-10 16S Ribosomal RNA Gene, Partial Sequence: GenBank: KF673157.1," Submitted Dec. 16, 2013.
Invitation to Pay Additional Fees, PCT Application No. PCT/US2015/038110, Sep. 22, 2015, 8 Pages.
PCT International Search Report and Written Opinion, PCT Application No. PCT/US2015/038187, Jan. 22, 2016, 36 Pages.
Baltruschat, H., et al., "Salt tolerance of barley induced by the root enjophyte *Piriformospora indica* is associated with a strong increase in antioxidants," New Phytologist., 2008, pp. 501-510, vol. 180.
Jalgaonwala, R., et al., "A Review on Microbial Endophytes from Plants: A Treasure Search for Biologically Active Metabolites," Global Journal of Research on Medicinal Plants & Indigenous Medicine, 2014, pp. 263-277, vol. 3, No. 6.
Redman, R. S., et al., "Thermotolerance Generated by Plant/Fungal Symbiosis," Science, Nov. 2002, vol. 298, 1 Page (with 4 pages of supplemental material).

\* cited by examiner

A)

B)

ENDOPHYTES, ASSOCIATED COMPOSITIONS, AND METHODS OF USE THEREOF

CROSS REFERENCE TO RELATED APPLICATIONS

This application is a continuation of U.S. patent application Ser. No. 14/752,829, filed Jun. 26, 2015, (pending) which is a continuation-in-part of International Application No. PCT/US2014/044427, filed Jun. 26, 2014 (pending) which is hereby incorporated in its entirety by reference. U.S. patent application Ser. No. 14/752,829, filed Jun. 26, 2015, (pending) claims the benefit of U.S. Provisional Application No. 62/017,796, filed Jun. 26, 2014, and U.S. Provisional Application No. 62/017,809, filed Jun. 26, 2014, and U.S. Provisional Application No. 62/017,816, filed Jun. 26, 2014, and U.S. Provisional Application No. 62/017,813, filed Jun. 26, 2014, and U.S. Provisional Application No. 62/017,815, filed Jun. 26, 2014, and U.S. Provisional Application No. 62/017,818, filed Jun. 26, 2014, each of which is hereby incorporated in its entirety by reference.

SEQUENCE LISTING

The instant application contains a Sequence Listing which has been submitted via EFS-Web and is hereby incorporated by reference in its entirety. Said ASCII copy, created on Sep. 2, 2015, is named 30696US_CRF_sequencelisting.txt, and is 2,970,000 bytes in size.

FIELD OF THE INVENTION

This invention relates to compositions and methods for improving the cultivation of plants, particularly agricultural plants. For example, this invention describes beneficial bacteria and fungi that are capable of living in a plant, which may be used to impart improved agronomic traits to plants. The disclosed invention also describes methods of improving plant characteristics by introducing such beneficial bacteria and/or fungi to those plants. Further, this invention also provides methods of treating seeds and other plant elements with beneficial bacteria and/or fungi that are capable of living within a plant, to impart improved agronomic characteristics to plants, particularly agricultural plants.

BACKGROUND

Agriculture faces numerous challenges that are making it increasingly difficult to provide food, materials, and fuels to the world's population. Population growth and changes in diet associated with rising incomes are increasing global food demand, while many key resources for agriculture are becoming increasingly scarce. By 2050, the FAO projects that total food production must increase by 70% to meet the needs of the growing population, a challenge that is exacerbated by numerous factors, including diminishing freshwater resources, increasing competition for arable land, rising energy prices, increasing input costs, and the likely need for crops to adapt to the pressures of a more extreme global climate. The need to grow nearly twice as much food in more uncertain climates is driving a critical need for new innovations.

Today, crop performance is optimized via of technologies directed towards the interplay between crop genotype (e.g., plant breeding, genetically-modified (GM) crops) and its surrounding environment (e.g., fertilizer, synthetic herbicides, pesticides). While these paradigms have assisted in doubling global food production in the past fifty years, yield growth rates have stalled in many major crops and shifts in the climate have been linked to production declines in important crops such as wheat. In addition to their long development and regulatory timelines, public fears of GM-crops and synthetic chemicals has challenged their use in many key crops and countries, resulting in a complete lack of acceptance for GM traits in wheat and the exclusion of GM crops and many synthetic chemistries from European markets. Thus, there is a significant need for innovative, effective, and publically-acceptable approaches to improving the intrinsic yield and resilience of crops to severe stresses.

Like humans, which benefit from a complement of beneficial microbial symbionts, plants have been purported to benefit somewhat from the vast array of bacteria and fungi that live both within and around their tissues to support their health and growth. Endophytes are fungal or bacterial organisms that live within plants. Bacterial and fungal endophytes appear to inhabit various host plant tissues and have been isolated from plant leaves, stems, or roots.

A small number of these symbiotic endophyte-host relationships have been purported in limited studies to provide agronomic benefits to model host plants within controlled laboratory settings, such as enhancement of biomass production (i.e., yield) and nutrition, increased tolerance to stress such as drought, and/or pests. Yet, such endophytes have been demonstrated to be ineffective in conferring benefits to a variety of agriculturally-important plants; as such, they do not adequately address the need to provide improved yield and tolerance to environmental stresses present in many agricultural situations for such crops.

Thus, there is a need for compositions and methods of providing agricultural crops with improved yield and resistance to various environmental stresses. Provided herein are novel compositions of bacterial and fungal endophytes and synthetic endophyte-plant compositions based on the analysis of the key properties that enhance the utility and commercialization of an endophytic composition.

SUMMARY OF THE INVENTION

The disclosures of PCT/US2014/044427, filed Jun. 26, 2014, and U.S. application Ser. No. 14/316,469, filed Jun. 26, 2014, are incorporated by reference in their entirety, including the sequence listing containing SEQ ID NOs: 1-1448.

The present invention is based on the surprising discovery that a number of bacterial and fungal taxa of endophytes microbes are conserved across diverse species and/or cultivars of agricultural plants, and can be derived therefrom and heterologously associated with diverse new cultivars to provide benefits. The present invention is also based on the discovery that a plant element of a plant can be effectively augmented by coating its surface with such endophytes in an amount that is not normally found on the plant element. The endophytes can be isolated from inside the same plant or a different plant, or from inside a part or tissue of the same plant or different plant. The plant element thus coated with the endophyte can be used to confer improved agronomic trait or traits to the seed or the plant that is grown from the plant element.

The inventors have postulated that attempts to select for cultivars with certain improved traits and alterations in the environmental and chemical conditions of agriculture have led to the inadvertent loss of microbes in modern varieties that can provide beneficial traits to agricultural plants. The present invention is based on the surprising discovery that many modern cultivars of agricultural plants display striking distinctions in their microbial communities when compared with ancestral varieties. The present invention is also based on the observation that, in some cases, providing the microbial taxa present in such ancestral cultivars but are absent or underrepresented in modern varieties can lead to dramatic improvements in a number of agronomic traits in the modern cultivars.

SUMMARY

Described herein are methods for preparing an agricultural seed composition comprising contacting the surface of a plurality of seeds with a formulation comprising a purified microbial population that comprises at least two endophytes that are heterologous to the seed. The first endophyte is capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin and the endophytes are present in the formulation in an amount capable of modulating a trait of agronomic importance, as compared to isoline plants grown from seeds not contacted with the formulation.

Also described herein are method for preparing an agricultural seed composition, comprising contacting the surface of a plurality of seeds with a formulation comprising a purified microbial population that comprises at least two endophytes that are heterologous to the seed. The first endophyte is capable of at least one function or activity selected from the group consisting of auxin production, nitrogen fixation, production of an antimicrobial compound, mineral phosphate solubilization, siderophore production, cellulase production, chitinase production, xylanase production, and acetoin production and the endophytes are present in the formulation in an amount capable of modulating a trait of agronomic importance, as compared to isoline plants grown from seeds not contacted with the formulation.

Also described are methods of improving a phenotype during water limited conditions of a plurality of host plants grown from a plurality of seeds, comprising treating the seeds with a formulation comprising at least two endophytes that are heterologous to the seeds. The first endophyte is capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin. The phenotype improvement is selected from the group consisting of: disease resistance, heat tolerance, cold tolerance, salinity tolerance, metal tolerance, herbicide tolerance, chemical tolerance, improved nitrogen utilization, improved resistance to nitrogen stress, improved nitrogen fixation, pest resistance, herbivore resistance, pathogen resistance, increased yield, health enhancement, vigor improvement, growth improvement, photosynthetic capability improvement, nutrition enhancement, altered protein content, altered oil content, increased biomass, increased shoot length, increased root length, improved root architecture, increased seed weight, altered seed carbohydrate composition, altered seed oil composition, number of pods, delayed senescence, stay-green, and altered seed protein composition, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant.

The seed or plant can be a dicot, e.g., soybean, cotton, tomato and pepper or a monocot, e.g., corn, wheat, barley and rice. In some embodiments, the seed is a transgenic seed.

The methods described herein include a first endophyte and a second endophyte. The first endophyte and/or the second endophyte can be, e.g., a bacterial endophyte or, e.g., a fungal endophyte. Examples of bacterial endophytes include, e.g., those from a genus selected from the group consisting of: *Acidovorax, Agrobacterium, Bacillus, Burkholderia, Chryseobacterium, Curtobacterium, Enterobacter, Escherichia, Methylobacterium, Paenibacillus, Pantoea, Pseudomonas, Ralstonia, Saccharibacillus, Sphingomonas*, and *Stenotrophomonas*. In some embodiments, the bacterial endophyte has a 16S rRNA sequence that is at least 95% identical to a sequence selected from the group consisting of: SEQ ID NOs: 3588, 3589, 3590, 3591, 3592, 3593, 3594, 3595, 3596, 3598, 3599, 3600, 3601, 3603, 3604, 3606, 3607, 3608, 3609, 3619, 3620, 3621, 3622, 3623, 3624, 3625, 3626, 3627, 3628, 3629, 3630, 3631, 3632, 3633, 3634, 3635, 3636, 3637, 3638, 3639, 3641, 3645, 3646, 3648, 3649, 3651, 3652, 3653, 3656, 3663, 3664, 3665, 3666, 3667, 3668, 3669, 3670, 3671.

Examples of fungal endophytes include, e.g., those from a genus selected from the group consisting of: *Acremonium, Alternaria, Cladosporium, Cochliobolus, Embellisia, Epicoccum, Fusarium, Nigrospora, Phoma*, and *Podospora*. In some embodiments, the fungal endophyte has an ITS rRNA at least 95% identical to a sequence selected from the group consisting of: SEQ ID NOs: 3597, 3602, 3605, 3610, 3611, 3612, 3613, 3614, 3615, 3616, 3617, 3618, 3640, 3642, 3643, 3644, 3647, 3650, 3654, 3655, 3657, 3658, 3659, 3660, 3661, 3662, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700.

In some embodiments, the formulation comprises at least two endophytic microbial entities provided in any of Tables 2B, 3B, 4B, and 15.

In some embodiments of the methods described herein, the first endophyte is capable of metabolizing at least two of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin. In some embodiments of the methods described herein, the second endophyte is capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin.

The methods described herein include a formulation. In some embodiments, the formulation comprises the purified microbial population at a concentration of at least about $10^2$ CFU/ml or spores/ml in a liquid formulation or about $10^2$ CFU/gm or spores/ml in a non-liquid formulation. In some embodiments, the formulation further comprises one or more of the following: a stabilizer, or a preservative, or a carrier, or a surfactant, or an anticomplex agent, or any combination thereof and/or one or more of the following: fungicide, nematicide, bactericide, insecticide, and herbicide.

In some embodiments, the methods described herein modulate a trait agronomic importance. The trait of agronomic importance can be, e.g., disease resistance, drought tolerance, heat tolerance, cold tolerance, salinity tolerance, metal tolerance, herbicide tolerance, chemical tolerance, improved water use efficiency, improved nitrogen utilization, improved resistance to nitrogen stress, improved nitrogen fixation, pest resistance, herbivore resistance, pathogen resistance, increased yield, increased yield under water-limited conditions, health enhancement, vigor improvement, growth improvement, photosynthetic capability improvement, nutrition enhancement, altered protein content, altered oil content, increased biomass, increased shoot length, increased root length, improved root architecture, increased seed weight, altered seed carbohydrate composition, altered seed oil composition, number of pods, delayed senescence, stay-green, and altered seed protein composition.

The methods described herein can include at least one endophyte capable of localizing in a plant element of a plant grown from said seed, said plant element selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud.

In some embodiments, the methods described herein further include placing the plurality of seeds into a substrate that promotes plant growth, including but not limited to soil. For examples, the seeds are placed in the soil in rows, with substantially equal spacing between each seed within each row.

Also described herein is a plant derived from the agricultural seed preparation of the methods described herein, wherein said plant comprises in at least one of its plant elements said endophytes, and/or wherein said progeny comprises in at least one of its plant elements said endophytes. Also described herein is a plurality of seed compositions prepared according to the methods described herein, wherein said seed compositions are confined within an object selected from the group consisting of: bottle, jar, ampule, package, vessel, bag, box, bin, envelope, carton, container, silo, shipping container, truck bed, and case.

Described herein are methods for preparing a seed comprising an endophyte population, said method comprising applying to an exterior surface of a seed a formulation comprising an endophyte population consisting essentially of an endophyte comprising a 16S rRNA or ITS rRNA nucleic acid sequence at least 95% identical to a nucleic acid sequence selected from the group consisting of SEQ ID NOs: 1-3700; methods for treating seedlings, the method comprising contacting foliage or the rhizosphere of a plurality of agricultural plant seedlings with a seed a formulation comprising an endophyte population consisting essentially of an endophyte comprising a 16S rRNA or ITS rRNA nucleic acid sequence at least 95% identical to a nucleic acid sequence selected from the group consisting of SEQ ID NOs: 1-3700; and growing the contacted seedlings; methods for modulating a plant trait comprising applying to vegetation or an area adjacent the vegetation, a seed a formulation comprising an endophyte population consisting essentially of an endophyte comprising a 16S rRNA or ITS rRNA nucleic acid sequence at least 95% identical to a nucleic acid sequence selected from the group consisting of SEQ ID NOs: 1-3700, wherein the formulation is capable of providing a benefit to the vegetation, or to a crop produced from the vegetation; and methods for modulating a plant trait comprising applying a formulation to soil, the seed a formulation comprising an endophyte population consisting essentially of an endophyte comprising a 16S rRNA or ITS rRNA nucleic acid sequence at least 95% identical to a nucleic acid sequence selected from the group consisting of SEQ ID NOs: 1-3700, wherein the formulation is capable of providing a benefit to seeds planted within the soil, or to a crop produced from plants grown in the soil. In some embodiments, the method includes applying or contacting by spraying, immersing, coating, encapsulating, or dusting the seeds or seedlings with the formulation.

Described herein are methods for improving an agricultural trait in an agricultural plant, the method comprising providing a modern agricultural plant, contacting said plant with a formulation comprising an endophyte derived from an ancestral plant in an amount effective to colonize the plant and allowing the plant to grow under conditions that allow the endophyte to colonize the plant, and methods for improving an agricultural trait in an agricultural plant, the method comprising providing an agricultural plant, contacting said plant with a formulation comprising an endophyte that is common to at least two donor plant types that is present in the formulation in an amount effective to colonize the plant, and growing the plants under conditions that allow the endophyte to improve a trait in the plant. In some embodiments, the endophyte comprises a 16S rRNA or ITS rRNA nucleic acid sequence at least 95% identical to a nucleic acid sequence selected from the group consisting of SEQ ID NOs: 1-3700. In some embodiments, the method includes applying or contacting by spraying, immersing, coating, encapsulating, or dusting the seeds or seedlings with the formulation.

The seed or plant can be a dicot, e.g., soybean, cotton, tomato and pepper or a monocot, e.g., corn, wheat, barley and rice. In some embodiments, the seed is a transgenic seed.

In some embodiments, the endophyte is capable of exhibiting production of an auxin, nitrogen fixation, production of an antimicrobial, production of a siderophore, mineral phosphate solubilization, production of a cellulase, production of a chitinase, production of a xylanase, or production of acetoin, e.g., the endophyte exhibits at least two of: production of an auxin, nitrogen fixation, production of an antimicrobial, production of a siderophore, mineral phosphate solubilization, production of a cellulase, production of a chitinase, production of a xylanase, and production of acetoin. In other embodiments, the endophyte is capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin. In further embodiments, the endophyte is capable of capable of metabolizing at least two of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin.

In some embodiments, the endophyte comprises a nucleic acid sequence that is at least 97% identical to any nucleic acid provided in Tables 1A, 2A, 3A, 4A, 5-14, 16-23, wherein the endophyte is present in the formulation in an amount effective to colonize the mature agricultural plant. In other embodiments, at least one of the endophytes comprises a nucleic acid sequence that is at least 97% identical to any nucleic acid provided in Tables 1A, 2A, 3A, 4A, 5-14, 16-23, wherein the endophyte is present in the formulation in an amount effective to colonize the mature agricultural plant.

The endophyte can be present at a concentration of, for example, at least $10^2$ CFU or spores/seed on the surface of the seeds after contacting.

In some embodiments, the methods described herein modulate a trait agronomic importance. The benefit or agricultural trait can be selected from the group consisting of: increased root biomass, increased root length, increased height, increased shoot length, increased leaf number, increased water use efficiency, increased tolerance to low nitrogen stress, increased nitrogen use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome, relative to reference seeds or agricultural plants derived from reference seeds. In some embodiments, the benefit or agricultural trait comprises at least two benefits or agricultural traits selected from the group consisting of: increased root biomass, increased root length, increased height, increased shoot length, increased leaf number, increased water use efficiency, increased tolerance to low nitrogen stress, increased nitrogen use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome, relative to reference seeds or plants derived from reference seeds. Examples include but are not limited to increased tolerance to low nitrogen stress or increased nitrogen use efficiency, and the endophyte is non-diazotrophic or increased tolerance to low nitrogen stress or increased nitrogen use efficiency, and the endophyte is diazotrophic.

In some embodiments, the formulation comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

The methods described herein can include contacting the seed or plant with at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores or more, of the endophyte.

In some embodiments of the methods described herein, the endophyte is present in the formulation in an amount effective to be detectable within a target tissue of the agricultural plant selected from a fruit, seed, leaf, root or portion thereof. For example, the population is detected in an amount of at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, in the target tissue. Alternatively or in addition, the endophyte is present in the formulation in an amount effective to increase the biomass and/or yield of the fruit or seed produced by the plant by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the fruit or seed of a reference agricultural plant. Alternatively or in addition, the endophyte is present in the formulation in an amount effective to detectably increase the biomass of the plant, or a part or a tissue type thereof, e.g., detectably increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with a reference agricultural plant. Alternatively or in addition, the endophyte is present in the formulation in an amount effective to detectably increase the rate of germination of the seed, e.g., increased by at least 0.5%, at least 1%, at least 2%, at least 3%, at least 5%, at least 10%, at least 20%, at least 30%, at least 40%, at least 50%, at least 60%, at least 70%, at least 80%, at least 90%, at least 100% or more, when compared with a reference agricultural plant.

Also described herein are synthetic compositions comprising a purified microbial population in association with a plurality of seeds or seedlings of an agricultural plant, wherein the purified microbial population comprises a first endophyte capable of at least one of: production of an auxin, nitrogen fixation, production of an antimicrobial, production of a siderophore, mineral phosphate solubilization, production of a cellulase, production of a chitinase, production of a xylanase, and production of acetoin, or a combination of two or more thereof, wherein the first endophyte comprises a 16S rRNA or ITS rRNA nucleic acid sequence at least 95% identical to a nucleic acid sequence selected from the group consisting of SEQ ID NOs: 1-3700, and wherein the endophyte is present in the synthetic combination in an amount effective to provide a benefit to the seeds or seedlings or the plants derived from the seeds or seedlings. In some embodiments, the formulation comprises at least two endophytes provided in any of Tables 2B, 3B, 4B, and 15.

Also described herein are synthetic compositions comprising a purified population in association with a plurality of seeds or seedlings of an agricultural plant, wherein the purified microbial population comprises a first endophyte wherein the first endophyte is capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin, wherein the first endophyte comprises a 16S rRNA or ITS rRNA nucleic acid sequence at least 95% identical to a nucleic acid sequence selected from the group consisting of SEQ ID NOs: 1-3700, and wherein the endophyte is present in the synthetic combination in an amount effective to provide a benefit to the seeds or seedlings or the plants derived from the seeds or seedlings. In some embodiments, the microbial population further comprises a second endophyte, wherein the first and second endophytes are independently capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin, or a combination of two or more thereof. In some embodiments, the two endophytes are provided in any of Tables 2B, 3B, 4B, and 15

Also described herein are synthetic compositions comprising at least two endophytes associated with a seed, wherein at least the first endophyte is heterologous to the seed and is capable of production of an auxin, nitrogen fixation, production of an antimicrobial, production of a siderophore, mineral phosphate solubilization, production of a cellulase, production of a chitinase, production of a xylanase, and production of acetoin, or a combination of two or more thereof, wherein the endophytes are present in the formulation in an amount effective to provide a benefit to the seeds or seedlings or the plants derived from the seeds or seedlings. In some embodiments, both of the endophytes are heterologous to the seed. In some embodiments, the first and second endophytes are independently capable of at least one of production of an auxin, nitrogen fixation, production of an antimicrobial, production of a siderophore, mineral phosphate solubilization, production of a cellulase, production of a chitinase, production of a xylanase, or production of acetoin, or a combination of two or more thereof. In some embodiments, first endophyte comprises a 16S rRNA or ITS rRNA nucleic acid sequence at least 95% identical to a nucleic acid sequence selected from the group consisting of SEQ ID NOs: 1-3700. In some embodiments, the formulation comprises at least two endophytes provided in any of Tables 2B, 3B, 4B, and 15.

Also described herein are synthetic compositions comprising at least two endophytes associated with a seed, wherein at least the first endophyte is heterologous to the seed and is capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin, wherein the endophytes are present in the formulation in an amount effective to provide a benefit to the seeds or seedlings or the plants derived from the seeds or seedlings. In some embodiments, both of the endophytes are heterologous to the seed. In some embodiments, the first and second endophytes are independently capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin, or a combination of two or more thereof. In some embodiments, first endophyte comprises a 16S rRNA or ITS rRNA nucleic acid sequence at least 95% identical to a nucleic acid sequence selected from the group consisting of SEQ ID NOs: 1-3700.

In some embodiments, the synthetic combinations described herein are disposed within a packaging material selected from a bag, box, bin, envelope, carton, or container. In some embodiments, the synthetic combinations described herein comprise 1000 seed weight amount of seeds, wherein the packaging material optionally comprises a dessicant, and wherein the synthetic combination optionally comprises an anti-fungal agent.

In some embodiments, the synthetic combinations described herein comprise a first endophyte that is localized on the surface of the seeds or seedlings; and/or obtained from a plant species other than the seeds or seedlings of the synthetic combination; and/or obtained from a plant cultivar different from the cultivar of the seeds or seedlings of the synthetic combination; and/or obtained from a plant cultivar that is the same as the cultivar of the seeds or seedlings of the synthetic combination.

In some embodiments, the synthetic compositions comprising a purified population in association with a plurality of seeds or seedlings of an agricultural plant the microbial population further comprise a second endophyte, for example, a second microbial endophyte having an 16S rRNA or ITS rRNA nucleic acid sequence less than 95% identical to that of the first microbial endophyte. In some embodiments, the first and second endophytes are independently capable of at least one of production of an auxin, nitrogen fixation, production of an antimicrobial, production of a siderophore, mineral phosphate solubilization, production of a cellulase, production of a chitinase, production of a xylanase, or production of acetoin, or a combination of two or more thereof.

In some embodiments, the synthetic combinations described herein comprise, for example, a first endophyte that is a bacterial endophyte; a first endophyte that is a bacterial endophyte and a second endophyte that is a bacterial endophyte; a first endophyte that is a bacterial endophyte and a second endophyte that is a fungal endophyte; a first endophyte that is a fungal endophyte; and/or a first endophyte that is a fungal endophyte and a second endophyte that is a fungal endophyte.

In the embodiments with a second endophyte, the bacterial endophyte can be, e.g., of a genus selected from the group consisting of: *Acidovorax, Agrobacterium, Bacillus, Burkholderia, Chryseobacterium, Curtobacterium, Enterobacter, Escherichia, Methylobacterium, Paenibacillus, Pantoea, Pseudomonas, Ralstonia, Saccharibacillus, Sphingomonas,* and *Stenotrophomonas*; and/or the bacterial endophyte can be one with a 16S rRNA sequence that is at least 95% identical to a sequence selected from the group consisting of: SEQ ID NOs: 3588, 3589, 3590, 3591, 3592, 3593, 3594, 3595, 3596, 3598, 3599, 3600, 3601, 3603, 3604, 3606, 3607, 3608, 3609, 3619, 3620, 3621, 3622, 3623, 3624, 3625, 3626, 3627, 3628, 3629, 3630, 3631, 3632, 3633, 3634, 3635, 3636, 3637, 3638, 3639, 3641, 3645, 3646, 3648, 3649, 3651, 3652, 3653, 3656, 3663, 3664, 3665, 3666, 3667, 3668, 3669, 3670, 3671.

The fungal endophyte can be, e.g., of a genus selected from the group consisting of: *Acremonium, Alternaria, Cladosporium, Cochliobolus, Embellisia, Epicoccum, Fusarium, Nigrospora, Phoma,* and *Podospora* and/or have an ITS rRNA at least 95% identical to a sequence selected from the group consisting of: SEQ ID NOs: 3597, 3602, 3605, 3610, 3611, 3612, 3613, 3614, 3615, 3616, 3617, 3618, 3640, 3642, 3643, 3644, 3647, 3650, 3654, 3655, 3657, 3658, 3659, 3660, 3661, 3662, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700.

The synthetic combinations described herein can include, for example, a first endophyte capable of at least two of: production of an auxin, nitrogen fixation, production of an antimicrobial, production of a siderophore, mineral phosphate solubilization, production of a cellulase, production of a chitinase, production of a xylanase, utilization of arabinose as a carbon source, and production of acetoin; and/or capable of metabolizing at least two of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin, or a combination of two or more thereof.

The synthetic combinations described herein can include, for example, a first endophyte comprises a nucleic acid sequence that is at least 97% identical to any nucleic acid provided in Tables 1A, 2A, 3A, 4A, 5-14, 16-23.

The synthetic combinations described herein can include, for example, first endophytes present in an amount of at least about 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU spores per seed.

In some embodiments, the synthetic combinations described herein comprise a benefit selected from the group consisting of increased root biomass, increased root length, increased height, increased shoot length, increased leaf number, increased water use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant. In some embodiments, the synthetic combinations described herein comprise at least two benefits selected from the group consisting of increased root biomass, increased root length, increased height, increased shoot length, increased leaf number, increased water use efficiency, increased tolerance to low nitrogen stress, increased nitrogen use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome, relative to a reference plant.

In some embodiments, the synthetic combinations described herein comprise seeds and the first endophyte is associated with the seeds as a coating on the surface of the seeds; and/or comprises seedlings and the first endophyte is contacted with the seedlings as a spray applied to one or more leaves and/or one or more roots of the seedlings; and/or further comprises one or more additional endophyte species.

The effective amount of the synthetic combinations described herein can be, for example, $1 \times 10^3$ CFU or spores/per seed; from about $1 \times 10^2$ CFU or spores/per seed to about $1 \times 10^8$ CFU or spores/per seed.

In some embodiments, the seed is a seed from an agricultural plant. In some embodiments, the seed is a transgenic seed.

The synthetic combinations described herein can further comprise, e.g., one or more of the following: a stabilizer, or a preservative, or a carrier, or a surfactant, or an anticomplex agent, or any combination thereof. In some embodiments, the synthetic combinations described herein further comprising one or more of the following: fungicide, nematicide, bactericide, insecticide, and herbicide.

Also described herein are a plurality of any of the synthetic combinations described herein, placed in a medium that promotes plant growth, said medium selected from the group consisting of: soil, hydroponic apparatus, and artificial growth medium. In some embodiments, the plurality of synthetic combinations are placed in the soil in rows, with substantially equal spacing between each seed within each row. Also described herein are a plurality of synthetic combinations confined within an object selected from the group consisting of: bottle, jar, ampule, package, vessel, bag, box, bin, envelope, carton, container, silo, shipping container, truck bed, and case; in some embodiments, the synthetic combinations are shelf-stable.

Also described herein are plants grown from the synthetic combinations described herein, said plant exhibiting an improved phenotype of agronomic interest, selected from the group consisting of: disease resistance, drought tolerance, heat tolerance, cold tolerance, salinity tolerance, metal tolerance, herbicide tolerance, chemical tolerance, improved water use efficiency, improved nitrogen utilization, improved nitrogen fixation, pest resistance, herbivore resistance, pathogen resistance, increased yield, increased yield under water-limited conditions, health enhancement, vigor improvement, growth improvement, photosynthetic capability improvement, nutrition enhancement, altered protein content, altered oil content, increased biomass, increased shoot length, increased root length, improved root architecture, increased seed weight, altered seed carbohydrate composition, altered seed oil composition, number of pods, delayed senescence, stay-green, and altered seed protein composition. In one embodiment, described herein is a plant or progeny of the plant of the synthetic combinations described herein, wherein said plant or progeny of the plant comprises in at least one of its plant elements said endophytes.

Described herein is an agricultural plant, or portion or tissue thereof, comprising a formulation comprising an endophyte that is common to at least two donor plant types that is disposed on an exterior surface of or within the plant in an amount effective to colonize the plant, and in an amount effective to provide a benefit to the modern agricultural plant. In some embodiments, the endophyte comprises a nucleic acid sequence that is at least 95% identical to a nucleic acid sequence provided in Tables 5-14. Also described herein is a modern agricultural plant, or portion or tissue thereof, comprising a formulation comprising an endophytic microbial entity derived from an ancestral agricultural plant that is disposed on an exterior surface of or within the plant in an amount effective to colonize the plant, and in an amount effective to provide a benefit to the modern agricultural plant. In some embodiments, the endophyte comprises a nucleic acid sequence that is at least 95% identical to a nucleic acid sequence provided in Tables 16-23.

The plants described herein are provided a benefit that is, for example, selected from the group consisting of increased root biomass, increased root length, increased height, increased shoot length, increased leaf number, increased water use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant. In some embodiments, at least two benefits are provided to the agricultural plant.

In some embodiments, the plant is contacted with at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores or more, of the endophyte.

In some embodiments, the plant is a seed. In some embodiments, the plant is a seed and the population is disposed on the surface of the seed.

The plants described herein are can include at least two endophytic microbial entities comprising a nucleic acid sequence that is at least 97% identical to any nucleic acid provided in Tables 1-10 in an amount effective to colonize the mature agricultural plant.

In some embodiments, the plant is a monocot, e.g., selected from the group consisting of corn, wheat, barley and rice. In some embodiments, the plant is a dicot, e.g., selected from the group consisting of a soybean, canola, cotton, tomato and pepper.

In some embodiments of the plants described herein, the endophyte can be disposed in an amount effective to be detectable within a target tissue of the mature target tissue of the mature agricultural plant selected from a fruit, seed, leaf, root or portion thereof In some embodiments of the plants described herein, the target tissue can be selected from the group consisting of the root, shoot, leaf, flower, fruit and seed.

In some embodiments of the plants described herein, the population can be detected in an amount of at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, in the plant or target tissue thereof.

In some embodiments of the plants described herein, the population of is disposed in an amount effective to be detectable in the rhizosphere surrounding the plant. For example, the population can be detected in an amount of at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, in the rhizosphere surrounding the plant.

In some embodiments of the plants described herein, the population is disposed in an amount effective to detectably increase the biomass of the plant. For example, the biomass of the plant can be detectably increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with a reference agricultural plant.

In some embodiments of the plants described herein, the population is disposed in an amount effective to increase the biomass of a fruit or seed of the plant. For example, the biomass of the fruit or seed of the plant can be detectably increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the fruit or seed of a reference agricultural plant.

In some embodiments of the plants described herein, the population is disposed in an amount effective to increase the height of the plant. For example, the height of the plant can be detectably increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the height of a reference agricultural plant.

In some embodiments of the plants described herein, the population is disposed in an amount effective to effective to increase resistance to any of the stress conditions selected from the group consisting of a drought stress, heat stress, cold stress, salt stress, and low mineral stress. For example, the population can be disposed in an amount effective to effective to increase resistance to any of the biotic stress conditions selected from the group consisting of a nematode stress, insect herbivory stress, fungal pathogen stress, bacterial pathogen stress, and viral pathogen stress.

Also described herein is agricultural product comprising a 1000 seed weight amount of a synthetic compositions described herein. In some embodiments, the endophytes are present in a concentration of from about $10^2$ to about $10^5$ CFU or spores/ml or from about $10^5$ to about $10^8$ CFU or spores/seed. In some embodiments, the benefit is selected from the group consisting of: increased root biomass, increased root length, increased height, increased shoot length, increased leaf number, increased water use efficiency, increased tolerance to low nitrogen stress, increased nitrogen use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant, or a combination thereof.

Described herein are commodity plant products comprising the plants described herein. In some embodiments, the product is a grain, a flour, a starch, a syrup, a meal, an oil, a film, a packaging, a nutraceutical product, a pulp, an animal feed, a fish fodder, a bulk material for industrial chemicals, a cereal product, a processed human-food product, a sugar or an alcohol and protein. Also described herein are method of producing a commodity plant product, comprising: obtaining a plant or plant tissue from any of the plants described herein, or progeny or derivative thereof, and producing the commodity plant product therefrom.

DETAILED DESCRIPTION

Figure 1:
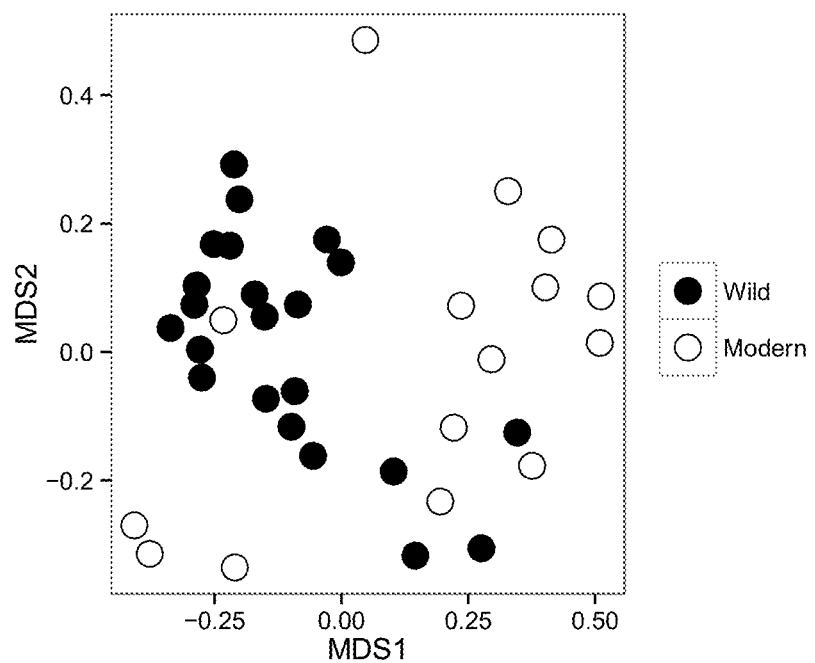
FIG. 1. Non-metric multidimensional scaling plot showing the differences in overall bacterial community composition between (A) wild and modern corn seeds and (B) wild and modern wheat seeds. Points represent community composition for an individual sample. Points closer together represent more similar communities while points further apart represent more dissimilar communities.
Figure 1:
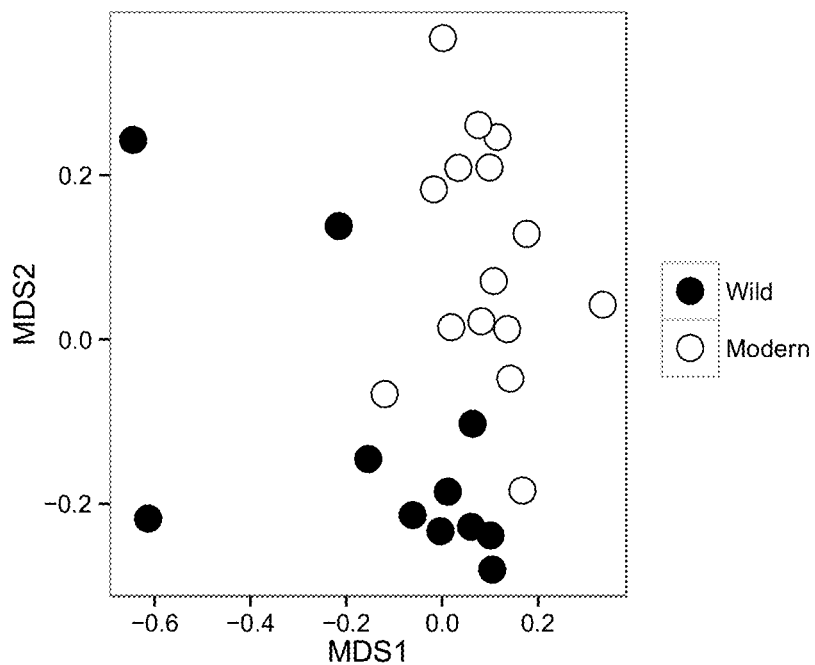
Figure 2:
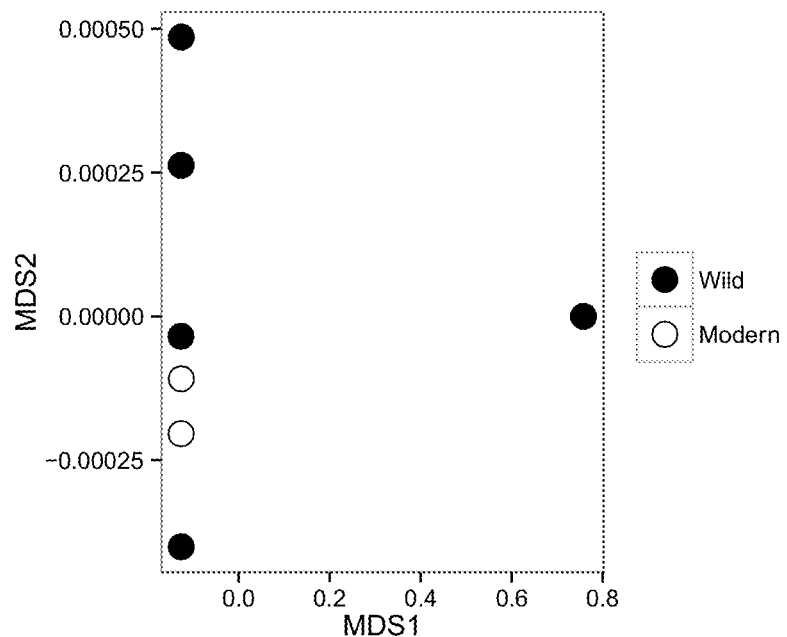
FIG. 2. Non-metric multidimensional scaling plot showing the differences in overall fungal community composition between (A) wild and modern corn seeds and (B) wild and modern wheat seeds. Points represent community composition for an individual sample. Points closer together represent more similar communities while points further apart represent more dissimilar communities.
Figure 2:
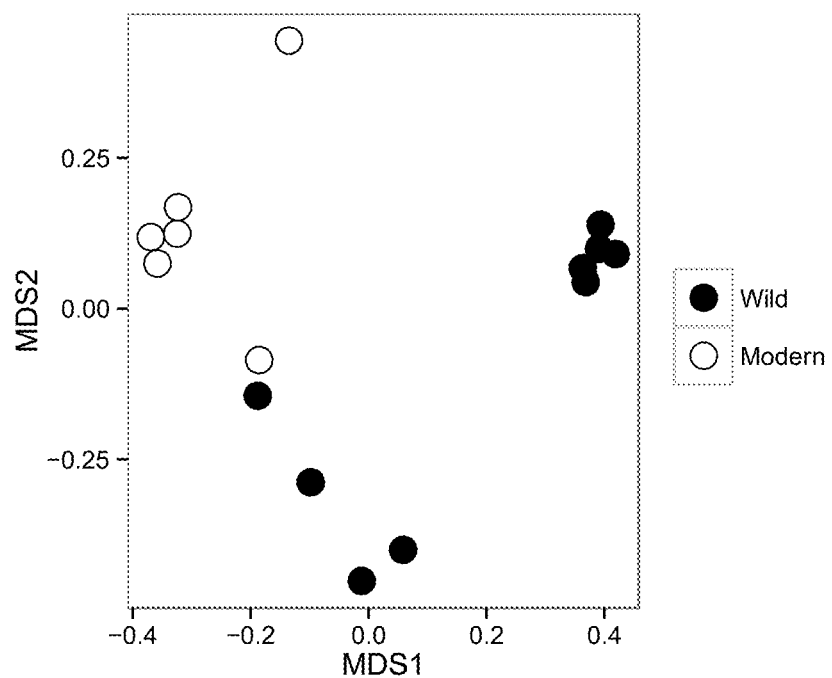

The inventors have undertaken a systematic comparison of the microbial communities that reside within a wide diversity of agricultural plants. The present invention is based on the striking finding that key constituents of the plant microbiome can be shared across diverse crop varieties, and the identification of bacterial and fungal species that provide diverse advantages to novel crop hosts via heterologous administration. As such, the endophytic microbes useful for the invention generally relate to endophytic microbes that are present in agricultural plants.

Currently, the generally accepted view of plant endophytic communities focuses on their homologous derivation, predominantly from the soil communities in which the plants are grown (Hallman, J., et al., (1997) Canadian Journal of Microbiology. 43(10): 895-914). Upon observing taxonomic overlap between the endophytic and soil microbiota in *A. thaliana*, it was stated, "Our rigorous definition of an endophytic compartment microbiome should facilitate controlled dissection of plant-microbe interactions derived from complex soil communities" (Lundberg et al., (2012) Nature. 488, 86-90). There is strong support in the art for soil representing the repository from which plant endophytes are derived. New Phytologist (2010) 185: 554-567. Notable plant-microbe interactions such as mycorrhyzal fungi and bacterial *rhizobia* fit the paradigm of soil-based colonization of plant hosts and appear to primarily establish themselves independently of seed. As a result of focusing attention on the derivation of endophytes from the soil in which the target agricultural plant is currently growing, there has been an inability to achieve commercially significant improvements in plant yields and other plant characteristics such as altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome relative to a reference plant.

In part, the present invention describes preparations of novel seed- or plant-derived endophytes, and the creation of synthetic combinations of agricultural seeds and/or seedlings with heterologous seed- or plant-derived endophytes and formulations containing the synthetic combinations, as well as the recognition that such synthetic combinations display a diversity of beneficial properties present in the agricultural plants and the associated endophyte populations newly created by the present inventors. Such beneficial properties include metabolism, transcript expression, proteome alterations, morphology, and the resilience to a variety of environmental stresses, and the combination of a plurality of such properties.

Little attention has been provided in the art to understand the role of plant elements as reservoirs for microbes that can efficiently populate the endosphere of agricultural plants. While the concept that plant elements may harbor plant pathogens was promoted by Baker and Smith (Annu Rev Phytopathol 14: 311-334 (1966)), and the understanding that bacterial and fungal pathogens are known to be able to infect plant elements, the ability to harness endophytes derived from a broad spectrum of plant elements to heterologously confer single or multiple advantages to agricultural crops was previously unrecognized. As the presence of detectable pathogens in a plant element lot can necessitate destruction of vast numbers of agricultural germplasm (Gitaitis, R. and Walcott, R. (2007) Annu Rev. Phytopathol. 45:371-97), safety concerns have surrounded the consideration of seed-associated microbes or non-soil endophytes. Moreover, when seed pathogens are detected, their transfer to the growing plant can be highly inefficient. For example, a study of seed-based transmission of the seed pathogen, *Pantoea stewartii*, found that seed produced from a population of pathogen-infected plants gave rise to infected seedlings in only 0.0029% of cases (1 of 34,924 plants) and artificially infected kernels only gave rise to infected seedlings in 0.022% of cases (Block, C. C., et al., (1998). Plant disease. 82(7). 775-780). Thus, the efficiency with which plants introduce microbes into their seeds, and with which microbes within seeds propagate within the resulting plant tissues, has been previously thought to be low and often substantially variable. Thus, the potential for microbial content within seeds to populate the resulting plant has been unclear.

The potential for agricultural plant elements to serve as reservoirs for non-pathogenic microbes also remains controversial (Hallman, J., et al., (1997) Canadian Journal of Microbiology. 43(10): 895-914). Sato, et al., did not detect any bacteria inside rice seeds ((2003) In. Morishima, H. (ed.) The Natural History of Wild Rice—Evolution Ecology of Crop. p. 91-106) and Mundt and Hinkle only obtained endophytes from seed samples where seed coats had been broken or fractured in 29 kinds of plant seed (Appl Environ Microbiol. (1976) 32(5):694-8). Another group detected simply bacterial populations inside rice seeds ranging in population size from $10^2$ to $10^6$ CFU/g fresh weight (Okunishi, S., et al., (2005) Microbes and Environment. 20:168-177). Rosenblueth et al described seeds to harbor very simple microbial communities with significant variability of the microbial communities between individual maize seeds, including substantial variability between seeds taken from the same cobb (Rosenblueth, M. et al, Seed Bacterial Endophytes: Common Genera, Seed-to-Seed Variability and Their Possible Role in Plants; Proc. XXVIIIth IHC—IS on Envtl., Edaphic & Gen. Factors; Affecting Plants, Seeds and Turfgrass; Eds.: G. E. Welbaum et al. Acta Hort. 938, ISHS 2012).

These findings demonstrate limitations recognized in the art regarding the attempted use of endophytes derived from seeds; i.e., maize seeds appear to contain limited taxonomic diversity, and that the microbiota of individual seeds produced by plants is often distinct, indicating that there may not be single seed- or plant-derived symbionts capable of providing benefits across a large population of agricultural plants and in specific, the utilization of endophytes on seed. For example, characterization of ~15 pooled seeds from within various cultivars from the genus *Zea* showed that populations of maize seeds tend to harbor a very limited number of taxa that appear to be conserved across modern and ancestral variants, and that the maize seed content of such taxa is low and substantially variable. It is unclear whether the presence of such limited taxa resulted from common storage conditions, environmental contamination, or a potential vertical transmission of microbes via seeds, and also uncertain was the applicability of such limited taxa in increasing agricultural yield. Notably, 99% of these strains were shown to provide detrimental or to lack beneficial effects on agricultural plants, e.g., when tested in a potato growth assay (Johnston-Monje D, Raizada M N (2011) Conservation and Diversity of Seed Associated Endophytes in *Zea* across Boundaries of Evolution, Ethnography and Ecology. PLoS ONE 6(6): e20396. doi:10.1371/journal.pone.0020396). Further, some of the microbes isolated bear close evolutionary relation to plant pathogens, making it possible that such microbes represent a latent reservoir of pathogens, rather than potentially beneficial constituents.

Surprisingly, we discovered here that seed- or plant-derived endophytes can confer significant advantages to agricultural crops, spanning growth under normal and stressed conditions, altered expression of key plant hormones, altered expression of key transcripts in the plant, and other desirable features. Provided are novel compositions, methods, and products related our invention's ability to overcome the limitations of the prior art in order to provide reliable increases in crop yield, biomass, germination, vigor, stress resilience, and other properties to agricultural crops.

Our invention is surprising for multiple reasons based on the previous demonstrations in the art. Notably, there has been a lack of clarity related to whether endophytes are associated with healthy plant elements, whether microbes isolated from plant elements could efficiently colonize the host if disposed on the exterior of a plant element or seedling, and whether such microbes would confer a beneficial or detrimental effects on hosts. It has been further unclear whether the heterologous application of such microbes to distinct plant elements from which they were derived could provide beneficial effects.

We find that beneficial microbes from within the conserved microbial taxa can be robustly derived from agricultural plant elements, optionally cultured, administered heterologously to agricultural plant elements or seedlings, and colonize the resulting plant tissues with high efficiency to confer multiple beneficial properties. This is surprising given the variability observed in the art in microbe isolation from healthy plant elements and the previous observations of inefficient plant element pathogen colonization of plant host's tissues. Further, the ability of heterologously disposed seed- or plant-derived endophytes to colonize seeds and seedlings from the exterior of seeds is surprising, given that such endophytes can be isolated from within internal seed tissues and therefore do not natively need the capacity to externally penetrate and invade into host tissues.

Prior characterization of microbial content of seeds has indicated that microbial concentrations in seeds can be variable and are generally very low (ie, less than 10, 100, $10^3$, $10^4$, $10^5$ CFUs/seed). As such, it has been unclear whether altered or increased concentrations of microbes associated with seeds could be beneficial. We find that microbes can confer beneficial properties across a range of concentrations.

A significant limitation of the existing art in endophytes is the very limited perspective on endophyte community compositions across a diversity of plant genotypes and environments. This has led to endophyte isolations that have lacked the ability to colonize multiple hosts or to reproducibly confer benefits in multiple locations and soil types.

The inventors conceived that the bacterial and fungal microbiota of large numbers of agricultural seeds and wild seeds from a diversity of geographic locations would have an improved ability to colonize and benefit multiple plant genotypes across multiple environments. The inventors have developed a method to introduce isolated endophytes to another plant by coating the microbes onto the surface of a seed of a plant. By combining an endophyte sourced from one plant, it is possible to transfer new beneficial agronomic traits onto an agricultural plant, which therefore holds great promise for increasing agricultural productivity. Additionally, as demonstrated herein, the microbial endophytes were in many cases able to additively confer benefits to recipient seeds, seedlings, or plants.

Combining a selected plant species, OTU, strain or cultivar with one or more types of endophytes thus provides mechanisms by which, alone or in parallel with plant breeding and transgenic technologies, is provided improved yield from crops and generation of products thereof. Therefore, in one aspect, the present invention provides a synthetic combination of a seed of a first plant and a preparation of an endophyte that is coated onto the surface of the seed of the first plant such that the endophyte is present at a higher level on the surface of the seed than is present on the surface of an uncoated reference seed, wherein the endophyte is isolated from the inside the seed of a second plant. As described herein, the combination is achieved by artificial coating, application, or other infection of a seed of a plant with an endophyte strain. In some embodiments, endophytes are introduced onto the surface of host plant seeds, which upon cultivation confer improved agronomic traits to said host plant, which may then generate progeny seeds.

Definitions

A "synthetic combination" includes a combination of a host plant and an endophyte. The combination may be achieved, for example, by coating the surface of the seed of a plant, such as an agricultural plant, or host plant tissues with an endophyte.

As used herein, an "agricultural seed" is a seed used to grow a plant in agriculture (an "agricultural plant"). The seed may be of a monocot or dicot plant, and is planted for the production of an agricultural product, for example grain, food, feed, fiber, fuel, etc. As used herein, an agricultural seed is a seed that is prepared for planting, for example, in farms for growing.

An "endophyte" or "endophytic entity" or "endophytic microbe" is an organism capable of living within a plant or is otherwise associated therewith, and does not cause disease or harm the plant otherwise. Endophytes can occupy the intracellular or extracellular spaces of plant tissue, including the leaves, stems, flowers, fruits, seeds, or roots. An endophyte can be for example a bacterial or fungal organism, and can confer a beneficial property to the host plant such as an increase in yield, biomass, resistance, or fitness. An endophyte can be a fungus, or a bacterium. As used herein, the term "microbe" is sometimes used to describe an endophyte. Further, "endophyte" means a microbe (typically a fungus or a bacterium) that is associated with a plant tissue and is in a symbiotic or other beneficial relationship with said plant tissue. As used herein, an "endophytic component" refers to a composition or structure that is part of the endophyte.

As used herein, the term "bacteria" or "bacterium" refers in general to any prokaryotic organism, and may reference an organism from either Kingdom Eubacteria (Bacteria), Kingdom Archaebacteria (Archae), or both.

"Internal Transcribed Spacer" (ITS) refers to the spacer DNA (non-coding DNA) situated between the small-subunit ribosomal RNA (rRNA) and large-subunit rRNA genes in the chromosome or the corresponding transcribed region in the polycistronic rRNA precursor transcript.

A "complex network" means a plurality of endophyte entities (e.g., simple bacteria or simple fungi, complex fungi, or combinations thereof) co-localized in an environment, such as on or within an agricultural plant. Preferably, a complex network includes two or more types of endophyte entities that synergistically interact, such synergistic endophytic populations capable of providing a benefit to the agricultural seed, seedling, or plant derived thereby.

A "population" of endophytes refers to the presence of more than one endophyte in a particular environment. The population may comprise more than one individual of the same taxonomy or more than one taxonomy of individuals. For example, a population may comprise $10^2$ colonies of *Cladosporium*. In another example, a population may comprise $10^2$ colonies of *Cladosporium* and $10^3$ colonies of *Penicillium*. A population may in general, but not be limited to, comprises individuals that are related by some feature, such as being in the same environment at the same time, or by virtue of sharing some phenotype such as ability to metabolize a particular substrate.

The terms "pathogen" and "pathogenic" in reference to a bacterium or fungus includes any such organism that is capable of causing or affecting a disease, disorder or condition of a host comprising the organism.

A "spore" or a population of "spores" refers to bacteria or fungi that are generally viable, more resistant to environmental influences such as heat and bactericidal or fungicidal agents than other forms of the same bacteria or fungi, and typically capable of germination and out-growth. Bacteria and fungi that are "capable of forming spores" are those bacteria and fungi comprising the genes and other necessary abilities to produce spores under suitable environmental conditions.

As used herein, a "colony-forming unit" ("CFU") is used as a measure of viable microorganisms in a sample. A CFU is an individual viable cell capable of forming on a solid medium a visible colony whose individual cells are derived by cell division from one parental cell.

The term "isolated" is intended to specifically reference an organism, cell, tissue, polynucleotide, or polypeptide that is removed from its original source and purified from additional components with which it was originally associated. For example, an endophyte may be considered isolated from a seed if it is removed from that seed source and purified so that it is isolated from any additional components with which it was originally associated. Similarly, an endophyte may be removed and purified from a plant or plant element so that it is isolated and no longer associated with its source plant or plant element.

A "plant element" is intended to generically reference either a whole plant or a plant component, including but not limited to plant tissues, parts, and cell types. A plant element is preferably one of the following: whole plant, seedling, meristematic tissue, ground tissue, vascular tissue, dermal tissue, seed, leaf, root, shoot, stem, flower, fruit, stolon, bulb, tuber, corm, kelkis, shoot, bud. As used herein, a "plant element" is synonymous to a "portion" of a plant, and refers to any part of the plant, and can include distinct tissues and/or organs, and may be used interchangeably with the term "tissue" throughout.

Similarly, a "plant reproductive element" is intended to generically reference any part of a plant that is able to initiate other plants via either sexual or asexual reproduction of that plant, for example but not limited to: seed, seedling, root, shoot, stolon, bulb, tuber, corm, keikis, or bud.

A "population" of plants, as used herein, can refer to a plurality of plants that were subjected to the same inoculation methods described herein, or a plurality of plants that are progeny of a plant or group of plants that were subjected to the inoculation methods. In addition, a population of plants can be a group of plants that are grown from coated seeds. The plants within a population will typically be of the same species, and will also typically share a common genetic derivation.

As used herein, an "agricultural seed" is a seed used to grow a plant typically used in agriculture (an "agricultural plant"). The seed may be of a monocot or dicot plant, and may be planted for the production of an agricultural product, for example feed, food, fiber, fuel, etc. As used herein, an agricultural seed is a seed that is prepared for planting, for example, in farms for growing.

"Agricultural plants", or "plants of agronomic importance", include plants that are cultivated by humans for food, feed, fiber, and fuel purposes. Agricultural plants include monocotyledonous species such as: maize (*Zea mays*), common wheat (*Triticum aestivum*), spelt (*Triticum spelta*), einkorn wheat (*Triticum monococcum*), emmer wheat (*Triticum dicoccum*), durum wheat (*Triticum durum*), Asian rice (*Oryza sativa*), African rice (*Oryza glabaerreima*), wild rice (*Zizania aquatica, Zizania latifolia, Zizania palustris, Zizania texana*), barley (*Hordeum vulgare*), Sorghum (*Sorghum bicolor*), Finger millet (*Eleusine coracana*), Proso millet (*Panicum miliaceum*), Pearl millet (*Pennisetum glaucum*), Foxtail millet (*Setaria italica*), Oat (*Avena sativa*), Triticale (*Triticosecale*), rye (*Secale cereale*), Russian wild rye (*Psathyrostachys juncea*), bamboo (*Bambuseae*), or sugarcane (e.g., *Saccharum arundinaceum, Saccharum barberi, Saccharum bengalense, Saccharum edule, Saccharum munja, Saccharum officinarum, Saccharum procerum, Saccharum ravennae, Saccharum robustum, Saccharum sinense,* or *Saccharum spontaneum*); as well as dicotyledonous species such as: soybean (*Glycine max*), canola and rapeseed cultivars (*Brassica napus*), cotton (genus *Gossypium*), alfalfa (*Medicago sativa*), cassava (genus *Manihot*), potato (*Solanum tuberosum*), tomato (*Solanum lycopersicum*), pea (*Pisum sativum*), chick pea (*Cicer arietinum*), lentil (*Lens culinaris*), flax (*Linum usitatissimum*) and many varieties of vegetables.

A "host plant" includes any plant, particularly a plant of agronomic importance, which an endophytic entity such as an endophyte can colonize. As used herein, an endophyte is said to "colonize" a plant or seed when it can be stably detected within the plant or seed over a period time, such as one or more days, weeks, months or years, in other words, a colonizing entity is not transiently associated with the plant or seed. Such host plants are preferably plants of agronomic importance. It is contemplated that any element, or more than one element, of the host plant may be colonized with an endophyte to thus confer a host status to the plant. The initial inoculated element may additionally be different than the element to which the endophyte localizes. An endophyte may localize to different elements of the same plant in a spatial or temporal manner. For example, a seed may be inoculated with an endophyte, and upon germination, the endophyte may localize to root tissue.

A "non-host target" means an organism or chemical compound that is altered in some way after contacting a host plant or host fungus that comprises an endophyte, as a result of a property conferred to the host plant or host fungus by the endophyte.

As used herein, an "ancestral" variety of a plant refers generally to a variety or species of a plant that is either a wild ancestor or undomesticated species of agricultural plants. Such ancestral varieties are generally distinguished from agricultural plants used in large-scale agricultural practices in use today in that the ancestral varieties were not extensively bred, and are generally open-pollinated. As used herein, ancestral varieties include landrace varieties, heirloom varieties, and progenitor species.

A "modern" variety of a plant refers to a non-ancestral variety of a plant.

As used herein, a "hybrid plant" refers generally refers to a plant that is the product of a cross between two genetically different parental plants. A hybrid plant is generated by either a natural or artificial process of hybridization whereby the entire genome of one species, variety cultivar, breeding line or individual plant is combined intra- or interspecifically into the genome of species, variety or cultivar or line, breeding line or individual plant by crossing.

An "inbred plant", as used herein, refers to a plant or plant line that has been repeatedly crossed or inbred to achieve a high degree of genetic uniformity, and low heterozygosity, as is known in the art.

The term "isoline" is a comparative term, and references organisms that are genetically identical, but may differ in treatment. In one example, two genetically identical maize plant embryos may be separated into two different groups, one receiving a treatment (such as transformation with a heterologous polynucleotide, to create a genetically modified plant) and one control that does not receive such treatment. Any phenotypic differences between the two groups may thus be attributed solely to the treatment and not to any inherency of the plant's genetic makeup. In another example, two genetically identical seeds may be treated with a formulation that introduces an endophyte composition. Any phenotypic differences between the plants grown from those seeds may be attributed to the treatment, thus forming an isoline comparison.

Similarly, by the term "reference agricultural plant", it is meant an agricultural plant of the same species, strain, or cultivar to which a treatment, formulation, composition or endophyte preparation as described herein is not administered/contacted. A reference agricultural plant, therefore, is identical to the treated plant with the exception of the presence of the endophyte and can serve as a control for detecting the effects of the endophyte that is conferred to the plant.

A "reference environment" refers to the environment, treatment or condition of the plant in which a measurement is made. For example, production of a compound in a plant associated with an endophyte can be measured in a reference environment of drought stress, and compared with the levels of the compound in a reference agricultural plant under the same conditions of drought stress. Alternatively, the levels of a compound in plant associated with an endophyte and reference agricultural plant can be measured under identical conditions of no stress.

In some embodiments, the invention contemplates the use of microbes that are "exogenous" to a seed or plant. As used herein, a microbe is considered exogenous to the seed or plant if the seed or seedling that is unmodified (e.g., a seed or seedling that is not treated with the endophytic microbial population descried herein) does not contain the microbe.

In some embodiments, a microbe can be "endogenous" to a seed or plant. As used herein, a microbe is considered "endogenous" to a plant or seed, if the endophyte or endophyte component is derived from, or is otherwise found in, a plant element of the plant specimen from which it is sourced. In embodiments in which an endogenous endophyte is applied, the endogenous microbe is applied in an amount that differs from the levels typically found in the plant.

In some embodiments, the invention uses endophytes that are heterologous to a plant element, for example in making synthetic combinations or agricultural formulations. A microbe is considered heterologous to the seed or plant if the seed or seedling that is unmodified (e.g., a seed or seedling that is not treated with an endophyte population described herein) does not contain detectable levels of the microbe. For example, the invention contemplates the synthetic combinations of seeds or seedlings of agricultural plants and an endophytic microbe population (e.g., an isolated bacterium), in which the microbe population is "heterologously disposed" on the exterior surface of or within a tissue of the agricultural seed or seedling in an amount effective to colonize the plant. A microbe is considered "heterologously disposed" on the surface or within a plant (or tissue) when the microbe is applied or disposed on the plant in a number that is not found on that plant before application of the microbe. For example, an endophyte population that is disposed on an exterior surface or within the seed can be an endophytic bacterium that may be associated with the mature plant, but is not found on the surface of or within the seed. As such, a microbe is deemed heterologously disposed when applied on the plant that either does not naturally have the microbe on its surface or within the particular tissue to which the microbe is disposed, or does not naturally have the microbe on its surface or within the particular tissue in the number that is being applied. The term "exogenous" can be used interchangeably with "heterologous." For example, a fungal endophyte that is normally associated with leaf tissue of a cupressaceous tree sample would be considered heterologous to leaf tissue of a maize plant. In another example, an endophyte that is normally associated with leaf tissue of a maize plant is considered heterologous to a leaf tissue of another maize plant that naturally lacks said endophyte. In another example, a fungal endophyte that is normally associated at low levels in a plant is considered heterologous to that plant if a higher concentration of that endophyte is introduced into the plant. In another example, an endophyte that is comprised within one fungus would be considered heterologous if placed in a different fungus. In yet another example, an endophyte that is associated with a tropical grass species would be considered heterologous to a wheat plant.

For the avoidance of doubt, "heterologously disposed" contemplates use of microbes that are "exogenous" to a seed or plant.

In some cases, the present invention contemplates the use of microbes that are "compatible" with agricultural chemicals, for example, a fungicide, an anti-bacterial compound, or any other agent widely used in agricultural which has the effect of interfering with optimal growth of microbes. As used herein, a microbe is "compatible" with an agricultural chemical, when the microbe is modified or otherwise adapted to grow in, or otherwise survive, the concentration of the agricultural chemical used in agriculture. For example, a microbe disposed on the surface of a seed is compatible with the fungicide metalaxyl if it is able to survive the concentrations that are applied on the seed surface.

"Biomass" means the total mass or weight (fresh or dry), at a given time, of a plant tissue, plant tissues, an entire plant, or population of plants, usually given as weight per unit area. The term may also refer to all the plants or species in the community (community biomass).

Some of the compositions and methods described herein involve endophytic microbes in an amount effective to colonize a plant. As used herein, a microbe is said to "colonize" a plant or seed when it can exist in an endophytic relationship with the plant in the plant environment, for example inside the plant or a part or tissue thereof, including the seed.

The compositions and methods herein may provide for an improved "agronomic trait" or "trait of agronomic importance" to a host plant, which may include, but not be limited to, the following: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome, compared to an isoline plant grown from a seed without said seed treatment formulation.

As used herein, the terms "water-limited condition" and "drought condition", or "water-limited" and "drought", may be used interchangeably. For example, a method or composition for improving a plant's ability to grown under drought conditions means the same as the ability to grow under water-limited conditions. In such cases, the plant can be further said to display improved drought tolerance.

Additionally, "altered metabolic function" or "altered enzymatic function" may include, but not be limited to, the following: altered production of an auxin, altered nitrogen fixation, altered production of an antimicrobial compound, altered production of a siderophore, altered mineral phosphate solubilization, altered production of a cellulase, altered production of a chitinase, altered production of a xylanase, altered production of acetoin.

An "increased yield" can refer to any increase in biomass or seed or fruit weight, seed size, seed number per plant, seed number per unit area, bushels per acre, tons per acre, kilo per hectare, or carbohydrate yield. Typically, the particular characteristic is designated when referring to increased yield, e.g., increased grain yield or increased seed size.

"Agronomic trait potential" is intended to mean a capability of a plant element for exhibiting a phenotype, preferably an improved agronomic trait, at some point during its life cycle, or conveying said phenotype to another plant element with which it is associated in the same plant. For example, a seed may comprise an endophyte that will provide benefit to leaf tissue of a plant from which the seed is grown; in such case, the seed comprising such endophyte has the agronomic trait potential for a particular phenotype (for example, increased biomass in the plant) even if the seed itself does not display said phenotype.

By the term "capable of metabolizing" a particular carbon substrate, it is meant that the endophyte is able to utilize that carbon substrate as an energy source.

The term "synthetic combination" means a plurality of elements associated by human endeavor, in which said association is not found in nature. In the present invention, "synthetic combination" is used to refer to a treatment formulation associated with a plant element.

A "treatment formulation" refers to a mixture of chemicals that facilitate the stability, storage, and/or application of the endophyte composition(s). In some embodiments, an agriculturally compatible carrier can be used to formulate an agricultural formulation or other composition that includes a purified endophyte preparation. As used herein an "agriculturally compatible carrier" refers to any material, other than water, that can be added to a plant element without causing or having an adverse effect on the plant element (e.g., reducing seed germination) or the plant that grows from the plant element, or the like.

In some cases, the present invention contemplates the use of compositions that are "compatible" with agricultural chemicals, for example, a fungicide, an anti-complex compound, or any other agent widely used in agricultural which has the effect of killing or otherwise interfering with optimal growth of another organism. As used herein, a composition is "compatible" with an agricultural chemical when the organism is modified, such as by genetic modification, e.g., contains a transgene that confers resistance to an herbicide, or is adapted to grow in, or otherwise survive, the concentration of the agricultural chemical used in agriculture. For example, an endophyte disposed on the surface of a seed is compatible with the fungicide metalaxyl if it is able to survive the concentrations that are applied on the seed surface.

Some compositions described herein contemplate the use of an agriculturally compatible carrier. As used herein an "agriculturally compatible carrier" is intended to refer to any material, other than water, which can be added to a seed or a seedling without causing/having an adverse effect on the seed, the plant that grows from the seed, seed germination, or the like.

A "transgenic plant" includes a plant or progeny plant of any subsequent generation derived therefrom, wherein the DNA of the plant or progeny thereof contains an introduced exogenous DNA segment not naturally present in a non-transgenic plant of the same strain. The transgenic plant may additionally contain sequences that are native to the plant being transformed, but wherein the "exogenous" gene has been altered in order to alter the level or pattern of expression of the gene, for example, by use of one or more heterologous regulatory or other elements.

As used herein, a nucleic acid has "homology" or is "homologous" to a second nucleic acid if the nucleic acid sequence has a similar sequence to the second nucleic acid sequence. The terms "identity", "percent sequence identity" or "identical" in the context of nucleic acid sequences refer to the residues in the two sequences that are the same when aligned for maximum correspondence. There are a number of different algorithms known in the art that can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990). The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% or 99% of the nucleotide bases, as measured by any well-known algorithm of sequence identity, such as FASTA, BLAST or Gap, as discussed above.

As used herein, the terms "operational taxonomic unit," "OTU," "taxon," "hierarchical cluster," and "cluster" are used interchangeably. An operational taxon unit (OTU) refers to a group of one or more organisms that comprises a node in a clustering tree. The level of a cluster is determined by its hierarchical order. In one embodiment, an OTU is a group tentatively assumed to be a valid taxon for purposes of phylogenetic analysis. In another embodiment, an OTU is any of the extant taxonomic units under study. In yet another embodiment, an OTU is given a name and a rank. For example, an OTU can represent a domain, a sub-domain, a kingdom, a sub-kingdom, a phylum, a sub-phylum, a class, a sub-class, an order, a sub-order, a family, a subfamily, a genus, a subgenus, or a species. In some embodiments, OTUs can represent one or more organisms from the kingdoms eubacteria, protista, or fungi at any level of a hierarchal order. In some embodiments, an OTU represents a prokaryotic or fungal order.

The terms "decreased", "fewer", "slower" and "increased" "faster" "enhanced" "greater" as used herein refers to a decrease or increase in a characteristic of the endophyte treated seed or resulting plant compared to an untreated seed or resulting plant. For example, a decrease in a characteristic may be at least 1%, at least 2%, at least 3%, at least 4%, at least 5%, at least 10%, at least 15%, at least 20%, at least 25%, at least 30%, at least 35%, at least 40%, at least 45%, at least 50%, at least about 60%, at least 75%, at least about 80%, at least about 90%, at least 100%, at least 200%, at least about 300%, at least about 400% or more lower than the untreated control and an increase may be at least 1%, at least 2%, at least 3%, at least 4%, at least 5%, at least 10%, at least 15%, at least 20%, at least 25%, at least 30%, at least 35%, at least 40%, at least 45%, at least 50%, at least about 60%, at least 75%, at least about 80%, at least about 90%, at least 100%, at least 200%, at least about 300%, at least about 400% or more higher than the untreated control.

The present invention is directed to methods and compositions of endophytes, and plant-endophyte combinations that confer a agronomic benefit in agricultural plants.

Endophytic Microbes

In part, the present invention describes preparations of novel seed- or plant-derived endophytes, including those that are conserved across diverse species and/or cultivars of agricultural plants, and the creation of synthetic combinations of agricultural seeds and/or seedlings with heterologous seed- or plant-derived endophytes and formulations containing the synthetic combinations, as well as the recognition that such synthetic combinations display a diversity of beneficial properties present in the agricultural plants and the associated endophyte populations newly created by the present inventors. Such beneficial properties include metabolism, transcript expression, proteome alterations, morphology, and the resilience to a variety of environmental stresses, and the combination of a plurality of such properties.

In a second aspect, the inventors have undertaken a systematic comparison of the microbial communities that reside within ancestral and closely related modern varieties of agricultural plants. The present invention is based on the striking differences the microbial composition between the ancestral and modern varieties, and the identification of bacterial and fungal species that are absent or vastly underrepresented in modern varieties. As such, the endophytic microbes useful for the invention generally relate to endophytic microbes that are present in ancestral varieties of plants.

Currently, the generally accepted view of plant endophytic communities focuses on their homologous derivation, predominantly from the soil communities in which the plants are grown (Hallman, J., et al., (1997) Canadian Journal of Microbiology. 43(10): 895-914). Upon observing taxonomic overlap between the endophytic and soil microbiota in *A. thaliana*, it was stated, "Our rigorous definition of an endophytic compartment microbiome should facilitate controlled dissection of plant-microbe interactions derived from complex soil communities" (Lundberg et al., (2012) Nature. 488, 86-90). There is strong support in the art for soil representing the repository from which plant endophytes are derived. New Phytologist (2010) 185: 554-567. Notable plant-microbe interactions such as mycorrhyzal fungi and bacterial *rhizobia* fit the paradigm of soil-based colonization of plant hosts and appear to primarily establish themselves independently of seed. As a result of focusing attention on the derivation of endophytes from the soil in which the target agricultural plant is currently growing, there has been an inability to achieve commercially significant improvements in plant yields and other plant characteristics such as: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, or a detectable modulation in the proteome relative to a reference plant.

Little attention has been provided in the art to understand the role of seeds as reservoirs for microbes that can efficiently populate the endosphere of agricultural plants. While the concept that seeds may harbor plant pathogens was promoted by Baker and Smith (Annu Rev Phytopathol 14: 311-334 (1966)), and the understanding that bacterial and fungal pathogens are known to be able to infect seed, the ability to harness endophytes derived from a broad spectrum of seeds to heterologously confer single or multiple advantages to agricultural crops was previously unrecognized. As the presence of detectable pathogens in a seed lot can necessitate destruction of vast numbers of agricultural germplasm (Gitaitis, R. and Walcott, R. (2007) Annu Rev. Phytopathol. 45:371-97), safety concerns have surrounded the consideration of seed-associated microbes or non-soil endophytes. Moreover, when seed pathogens are detected, their transfer to the growing plant can be highly inefficient. For example, a study of seed-based transmission of the seed pathogen, *Pantoea stewartii*, found that seed produced from a population of pathogen-infected plants gave rise to infected seedlings in only 0.0029% of cases (1 of 34,924 plants) and artificially infected kernels only gave rise to infected seedlings in 0.022% of cases (Block, C. C., et al., (1998). Plant disease. 82(7). 775-780). Thus, the efficiency with which plants introduce microbes into their seeds, and with which microbes within seeds propagate within the resulting plant tissues, has been previously thought to be low and often substantially variable. Thus, the potential for microbial content within seeds to populate the resulting plant has been unclear.

The potential for agricultural seeds to serve as reservoirs for non-pathogenic microbes also remains controversial (Hallman, J., et al., (1997) Canadian Journal of Microbiology. 43(10): 895-914). Sato, et al., did not detect any bacteria inside rice seeds ((2003) In. Morishima, H. (ed.) The Natural History of Wild Rice—Evolution Ecology of Crop. p. 91-106) and Mundt and Hinkle only obtained endophytes from seed samples where seed coats had been broken or fractured in 29 kinds of plant seed (Appl Environ Microbiol. (1976) 32(5):694-8). Another group detected simply bacterial populations inside rice seeds ranging in population size from $10^2$ to $10^6$ CFU/g fresh weight (Okunishi, S., et al., (2005) Microbes and Environment. 20:168-177). Rosenblueth et al described seeds to harbor very simple microbial communities with significant variability of the microbial communities between individual maize seeds, including substantial variability between seeds taken from the same cob (Rosenblueth, M. et al, Seed Bacterial Endophytes: Common Genera, Seed-to-Seed Variability and Their Possible Role in Plants; Proc. XXVIIIth IHC—IS on Envtl., Edaphic & Gen. Factors; Affecting Plants, Seeds and Turf; Eds.: G. E. Welbaum et al. Acta Hort. 938, ISHS 2012).

These findings demonstrate limitations recognized in the art regarding the attempted use of endophytes derived from seeds; i.e., maize seeds appear to contain limited taxonomic diversity, and that the microbiota of individual seeds produced by plants is often distinct, indicating that there may not be single seed- or plant-derived symbionts capable of providing benefits across a large population of agricultural plants and in specific, the utilization of endophytes on seed. For example, characterization of ~15 pooled seeds from within various cultivars from the genus *Zea* showed that populations of maize seeds tend to harbor a very limited number of taxa that appear to be conserved across modern and ancestral variants, and that the maize seed content of such taxa is low and substantially variable. It is unclear whether the presence of such limited taxa resulted from common storage conditions, environmental contamination, or a potential vertical transmission of microbes via seeds, and also uncertain was the applicability of such limited taxa in increasing agricultural yield. Notably, 99% of these strains were shown to provide detrimental or to lack beneficial effects on agricultural plants, e.g., when tested in a potato growth assay (Johnston-Monje D, Raizada M N (2011) Conservation and Diversity of Seed Associated Endophytes in *Zea* across Boundaries of Evolution, Ethnography and Ecology. PLoS ONE 6(6): e20396. doi:10.1371/journal.pone.0020396). Further, some of the microbes isolated bear close evolutionary relation to plant pathogens, making it possible that such microbes represent a latent reservoir of pathogens, rather than potentially beneficial constituents.

We discovered here that seed- or plant-derived endophytes can confer significant advantages to agricultural crops, spanning growth under normal and stressed conditions, altered expression of key plant hormones, altered expression of key transcripts in the plant, and other desirable features. Provided are novel compositions, methods, and products related our invention's ability to overcome the limitations of the prior art in order to provide reliable increases in crop yield, biomass, germination, vigor, stress resilience, and other properties to agricultural crops.

Our invention is surprising for multiple reasons based on the previous demonstrations in the art. Notably, there is a lack of clarity related to whether endophytes are associated with healthy seeds, whether microbes isolated from seeds could efficiently colonize the host if disposed on the exterior of a seed or seedling, and whether such microbes would confer a beneficial or detrimental effects on hosts. It is further unclear whether the heterologous application of such microbes to distinct seeds from which they were derived could provide beneficial effects.

We find that beneficial microbes can be robustly derived from agricultural seeds, optionally cultured, administered heterologously to agricultural seeds or seedlings, and colonize the resulting plant tissues with high efficiency to confer multiple beneficial properties. This is surprising given the variability observed in the art in microbe isolation from healthy seeds and the previous observations of inefficient seed pathogen colonization of plant host's tissues. Further, the ability of heterologously disposed seed- or plant-derived endophytes to colonize seeds and seedlings from the exterior of seeds is surprising, given that such endophytes can be isolated from within internal seed tissues and therefore do not natively need the capacity to externally penetrate and invade into host tissues.

Prior characterization of microbial content of seeds has indicated that microbial concentrations in seeds can be variable and are generally very low (ie, less than 10, 100, $10^3$, $10^4$, $10^5$ CFUs/seed). As such, it is unclear whether altered or increased concentrations of microbes associated with seeds could be beneficial. We find that microbes can confer beneficial properties across a range of concentrations.

We find that seed- or plant-derived endophytes can be heterologously disposed onto seedlings of a distinct cultivar, species, or crop type and confer benefits to those new recipients. For example, seed- or plant-derived endophytes from corn cultivars are heterologously provided to wheat cultivars to confer a benefit. This is surprising given the observations of distinct microbiome preferences in distinct plant and mammalian hosts and, in particular, the likelihood that microbes derived from seeds have been co-evolved to be specialized to a particular host.

As used herein, endophytes can be isolated from seeds of many distinct plants. In one embodiment, the endophyte can be isolated from the seed of the same crop, and can be from the same cultivar or variety as the seed onto which it is to be coated. For example, seed endophytes from a particular corn variety can be isolated and coated onto the surface of a corn seed of the same variety. In one particular embodiment, the seed of the first plant that is to be coated with the endophyte can comprise a detectable amount of the same endophyte in the interior of the seed. In another embodiment, the seed of the first plant that is to be coated with the endophyte can comprise a detectable amount of the same endophyte in the exterior of the seed. For example, an uncoated reference seed may contain a detectable amount of the same endophyte within its seed. In yet another embodiment, the endophyte to be coated onto the seed of the plant is a microbe that is detectably present in the interior and exterior of the seed from which the endophyte is derived.

In another embodiment, the endophyte can be isolated from a related species (e.g., an endophyte isolated from *Triticum monococcum* (einkorn wheat) can be coated onto the surface of a *T. aestivum* (common wheat) seed; or, an endophyte from *Hordeum vulgare* (barley) can be isolated and coated onto the seed of another member of the Triticeae family, for example, seeds of the rye plant, *Secale cereale*). In still another embodiment, the endophyte can be isolated from the seed of a plant that is distantly related to the seed onto which the endophyte is to be coated. For example, a tomato-derived endophyte is isolated and coated onto a rice seed.

In one embodiment, the endophyte is an endophytic microbe that was isolated from a different plant than the inoculated plant. For example, in one embodiment, the endophyte can be an endophyte isolated from a different plant of the same species as the inoculated plant. In some cases, the endophyte can be isolated from a species related to the inoculated plant.

We further find that combinations of heterologously disposed seed- or plant-derived endophytes confer additive advantages to plants, including multiple functional properties and resulting in seed, seedling, and plant hosts that display single or multiple improved agronomic properties.

In another embodiment, the endophytic microbe is absent in a seed of a modern variety of a plant. In still another embodiment, the endophytic microbe is detectably underrepresented in the seed of a modern variety of a plant when compared with a related ancestral variety.

According to the present invention, the endophytic microbe can be a bacterium. In some embodiments of the present invention, the endophyte is a member of one of the following taxa: *Achromobacter, Acidithiobacillus, Acidovorax, Acidovoraz, Acinetobacter, Actinoplanes, Adlercreutzia, Aerococcus, Aeromonas, Afipia, Agromyces, Ancylobacter, Arthrobacter, Atopostipes, Azospirillum, Bacillus, Bdellovibrio, Beijerinckia, Bosea, Bradyrhizobium, Brevibacillus, Brevundimonas, Burkholderia, Candidatus Haloredivivus, Caulobacter, Cellulomonas, Cellvibrio, Chryseobacterium, Citrobacter, Clostridium, Coraliomargarita, Corynebacterium, Cupriavidus, Curtobacterium, Curvibacter, Deinococcus, Delftia, Desemzia, Devosia, Dokdonella, Dyella, Enhydrobacter, Enterobacter, Enterococcus, Erwinia, Escherichia, Escherichia/Shigella, Exiguobacterium, Ferroglobus, Filimonas, Finegoldia, Flavisolibacter, Flavobacterium, Frigoribacterium, Gluconacetobacter, Hafnia, Halobaculum, Halomonas, Halosimplex, Herbaspirillum, Hymenobacter, Klebsiella, Kocuria, Kosakonia, Lactobacillus, Leclercia, Lentzea, Luteibacter, Luteimonas, Massilia, Mesorhizobium, Methylobacterium, Microbacterium, Micrococcus, Microvirga, Mycobacterium, Neisseria, Nocardia, Oceanibaculum, Ochrobactrum, Okibacterium, Oligotropha, Oryzihumus, Oxalophagus, Paenibacillus, Pantoea, Pantoea, Pelomonas, Perlucidibaca, Plantibacter, Polynucleobacter, Propionibacterium, Propioniciclava, Pseudoclavibacter, Pseudomonas, Pseudonocardia, Pseudoxanthomonas, Psychrobacter, Ralstonia, Rheinheimera, Rhizobium, Rhodococcus, Rhodopseudomonas, Roseateles, Ruminococcus, Sebaldella, Sediminibacillus, Sediminibacterium, Serratia, Shigella, Shinella, Sinorhizobium, Sinosporangium, Sphingobacterium, Sphingomonas, Sphingopyxis, Sphingosinicella, Staphylococcus, Stenotrophomonas, Strenotrophomonas, Streptococcus, Streptomyces, Stygiolobus, Sulfurisphaera, Tatumella, Tepidimonas, Thermomonas, Thiobacillus, Variovorax,* WPS-2_genera_incertae_sedis, *Xanthomonas, Zimmermannella.*

In one embodiment, the endophytic bacterium is of a family selected from the group consisting of: Bacillaceae, Burkholderiaceae, Comamonadaceae, Enterobacteriaceae, Flavobacteriaceae, Methylobacteriaceae, Microbacteriaceae, Paenibacillileae, Pseudomonnaceae, Rhizobiaceae, Sphingomonadaceae, Xanthomonadaceae.

In one embodiment, the endophytic bacterium is of a genus selected from the group consisting of: *Acidovorax, Agrobacterium, Bacillus, Burkholderia, Chryseobacterium, Curtobacterium, Enterobacter, Escherichia, Methylobacterium, Paenibacillus, Pantoea, Pseudomonas, Ralstonia,* Saccharibacillus, *Sphingomonas,* and *Stenotrophomonas*.

In one embodiment, the endophytic bacterium comprising in its genome a nucleic acid sequence selected from the group consisting of: SEQ ID NOs: 3588, 3589, 3590, 3591, 3592, 3593, 3594, 3595, 3596, 3598, 3599, 3600, 3601, 3603, 3604, 3606, 3607, 3608, 3609, 3619, 3620, 3621, 3622, 3623, 3624, 3625, 3626, 3627, 3628, 3629, 3630, 3631, 3632, 3633, 3634, 3635, 3636, 3637, 3638, 3639, 3641, 3645, 3646, 3648, 3649, 3651, 3652, 3653, 3656, 3663, 3664, 3665, 3666, 3667, 3668, 3669, 3670, 3671.

In one embodiment, the endophytic bacterium comprises in its genome a nucleic acid sequence that is at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence selected from the group consisting of: SEQ ID NOs: 3588, 3589, 3590, 3591, 3592, 3593, 3594, 3595, 3596, 3598, 3599, 3600, 3601, 3603, 3604, 3606, 3607, 3608, 3609, 3619, 3620, 3621, 3622, 3623, 3624, 3625, 3626, 3627, 3628, 3629, 3630, 3631, 3632, 3633, 3634, 3635, 3636, 3637, 3638, 3639, 3641, 3645, 3646, 3648, 3649, 3651, 3652, 3653, 3656, 3663, 3664, 3665, 3666, 3667, 3668, 3669, 3670, 3671.

In another embodiment, the endophytic microbe is a fungus. In some embodiments of the present invention, the endophyte is a member of one the following taxa: *Acidomyces acidophilus, Acremonium alternatum, Acremonium pteridii, Acremonium strictum, Acrodictys elaeidicola, Acrostalagmus luteoalbus, Albatrellus higanensis, Albonectria rigidiuscula, Alternaria alternate, Alternaria arborescens, Alternaria conjuncta, Alternaria helianthi, Alternaria longipes, Alternaria malorum, Alternaria metachromatica, Alternaria oregonensis, Alternaria photistica, Alternaria protenta, Alternaria tenuissima, Alternaria triticina, Alternaria zinniae, Amorphotheca resinae, Ampelomyces humuli, Anthostomella protege, Apiognomonia errabunda, Aposphaeria populina, Arthrinium sacchari, Aspergillus aculeatus, Aspergillus niger, Aspergillus versicolor, Athelia bombacina, Aureobasidium pullulans, Bartalinia laurinia, Bartalinia pondoensis, Bartalinia robillardoides, Beauveria bassiana, Bionectria ochroleuca, Bipolaris papendorfii, Boeremia exigua* var. *exigua, Botryosphaeria rhodina, Botrytis cinerea, Brachysporium nigrum, Cadophora (Phialophora) finlandica, Camarosporium palliatum, Camarosporium propinquum, Candida tropicalis, Capnodium coffeae, Ceratobasidium cornigerum, Ceratobasidium obscurum, Cercophora terricola, Chaetomium globosum, Chaetomium sphaerale, Chaetosphaeria endophytica, Chaetosphaeria ovoidea, Chaunopycnis alba, Chaunopycnis pustulata, Chloridium phaeosporum, Chloridium preussii, Chromelosporium fulvum, Cladorrhinum bulbillosum, Cladosporium cladosporioides, Cladosporium edgeworthrae, Cladosporium her-* barum, Cladosporium orchidis, Cladosporium oxysporum, Cladosporium tenuissimum, Clonostachys rosea, Clonostachys rosea f. catenulate, Cochliobolus australiensis, Cochliobolus geniculatus, Cochliobolus hawaiiensis, Cochliobolus lunatus, Cochliobolus tuberculatus, Colletotrichum acutatum, Colletotrichum capsici, Colletotrichum crassipes, Colletotrichum dematium, Colletotrichum gloeosporioides, Colletotrichum magna, Colletotrichum musae, Colletotrichum orbiculare, Colletotrichum truncatum, Coniella minima, Coniochaeta tetraspora, Coniochaeta velutina, Coniophora puteana, Coprinellus disseminates, Coprinellys radians, Cordyceps sinensis, Corynascus kuwaitiensis, Corynespora cassiicola, Crinipellis roreri, Cryphonectria parasitica, Cryptococcus victoriae, Curvularia affinis, Curvularia oryzae, Curvularia senegalensis, Curvularia sichuanensis, Cytosphaera mangiferae, Cytospora eucalypticola, Daldinia eschscholzi., Davidiella tassiana, Debaryomyces hansenii, Deightoniella torulosa, Diaporthe cynaroidis, Diaporthe eres, Diaporthe helianthi, Diaporthe phaseolorum, Dictyochaeta triseptata, Dothiorella aromatics, Dothiorella dominicana, Drechslera ellisii, Elsinoe veneta, Embellisia eureka, Emericella nidulans, Engyodontium album, Epicoccum nigrum, Epulorhiza anaticula, Epulorhiza repens, Eurotium amstelodami, Exserohilum rostratum, Fasciatispora petrakii, Fimetariella rabenhorstii, Fomes fomentarius, Fomes fomentarius, Fomitopsis ostreiformis, Fomitopsis pinicola, Fusarium anthophilum, Fusarium aquaeductuum, Fusarium avenaceum, Fusarium bulbicola, Fusarium chlamydosporum, Fusarium culmorum, Fusarium equiseti, Fusarium incarnatum, Fusarium lichenicola, Fusarium moniliforme, Fusarium oxysporum, Fusarium poae, Fusarium polyphialidicum, Fusarium proliferatum, Fusarium pulverosum, Fusarium semitectum var. majus, Fusarium solani, Fusarium sporotrichioides, Fusarium tricinctum, Fusarium verticillioides, Fusicladium britannicum, Ganoderma tsugae, Geomyces vinaceus, Gibberella avenacea, Gibberella baccata, Gibberella fujikuroi, Gibberella moniliformis, Gibberella zeae, Gliomastix murorum, Glomerella cingulata, Glomerella cingulate, Guignardi bidwelli, Guignardia camelliae, Guignardia citricarpa, Guignardia cocoicola, Guignardia mangiferae, Guignardia mangiferae, Guignardia vaccinii, Haematonectria haematococca, Haplotrichum minitissimum, Helgardia anguioides, Helminthosporium chlorophorae, Hypocrea vixens, Hypoxylon fragiforme, Hypoxylon serpens, Hypoxylon stygium, Idriella amazonica, Idriella asaicola, Idriella euterpes, Idriella licualae, Ilyonectria radicicola, Kabatiella caulivora, Kluyveromyces marxianus, Kretzschmaria deusta, Lasiodiplodia pseudotheobromae, Lasiodiplodia theobromae, Laspora coronate, Leiosphaerella cocoes, Lentinus squarrosulus, Lepteutypa cupressi, Leptosphaeria coniothyrium, Leptosphaerulina trifolii, Letendraeopsis palmarum, Leucostoma niveum, Lewia eureka, Lewia eureka, Lunulospora curvula, Macrophomina phaseolina, Malbranchea circinate, Massarina arundinariae, Melanospora zamiae, Melanotus subcuneiformis, Melanotus subcuneiformis, Microascus cinereus, Minimidochium setosum, Moniliopsis anomala, Monodictys levis, Morchella elata, Mortierella alpine, Mucor fragilis, Mucor racemosus, Muscodor albus, Mycena murina, Mycocentrospora acerina, Myriangium duriaei, Nectria haematococca, Nemania aenea, Nemania bipapillata, Nemania serpens, Neofusicoccum mangiferae, Neotyphodium lolii, Neurospora crassa, Nigrospora oryzae, Nigrospora sphaerica, Nodulisporium anamorph of Hypoxylon fragiforme, Nodulisporium anamorph of Hypoxylon fuscum, Nodulisporium gregarium, Ochrocladosporium elatum, Ophiocordyceps sobolifera, Ophiostoma stenoceras, Oxydothis poliothea, Paecilomyces formosus, Papulosa amerospora, Paraconiothyrium minitans, Paraphaeosphaeria quadriseptata, Penicillium biourgeianum, Penicillium brevicompactum, Peniophora cinerea, Periconia anamorph of Didymosphaeria igniaria, Periconia digitata, Periconia hispidula, Periconia prolifica, Pestalotiopsis adusta, Pestalotiopsis caudata, Pestalotiopsis guepinii, Pestalotiopsis maculiformans, Pestalotiopsis microspora, Pestalotiopsis palmarum, Pestalotiopsis versicolor, Petriella sordida, Peziza varia, Peziza vesiculosa, Phaeangium lefebvrei, Phaedothis winteri, Phaeomoniella chlamydospora, Phaeotrichoconis crotalariae, Phanerochaete affinis, Phanerochaete sordida, Phialemonium dimorphosporum, Phlebia radiate, Phlogicylindrium eucalypti, Phoma glomerate, Phoma herbarum, Phoma leveillei, Phoma moricola, Phoma radicina, Phoma sorghina, Phoma subglomerata, Phoma tracheiphila, Phoma tropica, Phomatospora bellaminuta, Phomatospora berkeleyi, Phomopsis anacardii, Phomopsis casuarinae, Phomopsis leptostromiformis, Phomopsis mangiferae, Phomopsis manilkarae, Phomopsis orchidophila, Phyllosticta capitalensis, Phyllosticta colocasiicola, Phyllosticta minima, Phyllosticta sapotae, Piptarthron macrosporum, Piricauda pelagica, Piriformospora indica, Plagiostoma euphorbiae, Plenodomus fuscomaculans, Pleurophoma cava, Pleurotus ostreatus, Podospora fimbriata, Porosphaerella borinquensis, Preussia mediterranea, Preussia minima, Pseudocercospora punicae, Pseudocochliobolus pallescens, Pycnoporus cinnabarinus, Pycnoporus sanguineus, Pyriculariopsis parasitica, Ramichloridium apiculatum, Ramichloridium biverticillatum, Rhizopus stolonifer, Rhizopycnis vagum, Rhizosphaera kalkhoffii, Rhodotorula minuta, Schizophyllum commune, Scolecobasidium terreum, Scolicotrichum musae, Scopuloides hydnoides, Scytalidium lignicola, Sebacina vermifera, Septoria anacardii, Setosphaeria rostrata, Sordaria fimicola, Sordaria tomento-alba, Sporormiella minima, Stagonosporopsis dorenboschii, Stemphylium botryosum, Stemphylium solani, Stilbohypoxylon quisquiliarum var. quisquiliarum, Streptomyces albosporus, Streptomyces aureus, Streptomyces cinereus, Streptomyces glaucus, Streptomyces globisporus, Streptomyces griseofuscus, Streptomyces griseoorubroviolaceus, Streptomyces hygroscopicus, Streptomyces roseosporus, Sydowia polyspora, Talaromyces flavus, Talaromyces ohiensis, Talaromyces ohiensis, Tetracladium furcatum, Thanatephorus cucumeris, Thanatephorus pennatus, Thermomyces lanuginosus, Thumenella cubispora, Torula herbarum f quaternella, Trametes hirsuta, Trematosphaeria pertusa, Trichoderma hamatum, Trichoderma harzianum, Trichoderma koningii, Trichoderma longibrachiatum, Trichoderma viride, Trichothecium roseum, Triscelophorus acuminatus, Triscelophorus konajensis, Triscelophorus monosporus, Truncatella angustata, Truncatella conorumpiceae, Tulasnella calospora, Ulocladium atrum, Ulocladium cucurbitae, Ustilago williamsii, Valsa ceratosperma, Verruculina enalia, Verticillium lecanii, Wiesneriomyces laurinus, Wrightoporia tropicalis, Xylaria acuta, Xylaria adscendens, Xylaria allantoidea, Xylaria anisopleura, Xylaria arbuscula, Xylaria castorea Berk., Xylaria coccophora, Xylaria cubensis, Xylaria curta, Xylaria hypoxylon, Xylaria microceras, Xylaria multiplex, Xylaria obovata, Xylaria palmicola, Xylaria telfairii, Zalerion maritimum, Zygosporium echinosporum, Zygosporium gibbum.

In one embodiment, the endophytic fungus is of a family selected from the group consisting of: Cladosporiaceae, Gnomoniaceae, Incertae sedis, Lasiosphaeriaceae, Netriaceae, Pleosporaceae.

In one embodiment, the endophytic fungus is of a genus selected from the group consisting of: *Acremonium, Alternaria, Cladosporium, Cochliobolus, Embellisia, Epicoccum, Fusarium, Nigrospora, Phoma,* and *Podospora.* In some embodiments, the endophytic fungus is of species *Acremonium strictum, Acremonium zeae, Alternaria alternate, Alternaria epidermidis, Alternaria infectoria, Alternaria tenuissima, Cladosporium tenuissimum, Epicoccum nigrum, Epicoccum sorghinum, Fusarium nigrum, Fusarium udum, Fusarium verticillioides,* and *Nigrospora oryza.*

In one embodiment, the endophytic bacterium comprising in its genome a nucleic acid sequence selected from the group consisting of: SEQ ID NOs: 3597, 3602, 3605, 3610, 3611, 3612, 3613, 3614, 3615, 3616, 3617, 3618, 3640, 3642, 3643, 3644, 3647, 3650, 3654, 3655, 3657, 3658, 3659, 3660, 3661, 3662, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700.

In one embodiment, the endophytic fungus comprises in its genome a nucleic acid sequence that is at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence selected from the group consisting of: SEQ ID NOs: 3597, 3602, 3605, 3610, 3611, 3612, 3613, 3614, 3615, 3616, 3617, 3618, 3640, 3642, 3643, 3644, 3647, 3650, 3654, 3655, 3657, 3658, 3659, 3660, 3661, 3662, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700.

In one embodiment, the endophyte comprises comprising in its genome a nucleic acid sequence a nucleic acid sequence that is at least 90% identical, for example, at least 91% identical, at least 92% identical, at least 93% identical, at least 94% identical, at least 95% identical, at least 96% identical, at least 97% identical, at least 98% identical, at least 99% identical, at least 99.5% identical or 100% identical, to a nucleic acid sequences found among the group consisting of SEQ ID NOs: 1-3700.

In some aspects, the endophyte of any method or composition of the present invention comprises a nucleic acid sequence that is at least 90% identical, for example, at least 91% identical, at least 92% identical, at least 93% identical, at least 94% identical, at least 95% identical, at least 96% identical, at least 97% identical, at least 98% identical, at least 99% identical, at least 99.5% identical or 100% identical to any nucleic acid provided in Tables 1A, 2A, 3A, 4A, 5-14, 16-23.

Exogenous Endophytes.

In one embodiment, the endophyte is an endophytic microbe that was isolated from a different plant than the inoculated plant. For example, in one embodiment, the endophyte can be an endophyte isolated from a different plant of the same species as the inoculated plant. In some cases, the endophyte can be isolated from a species related to the inoculated plant.

The breeding of plants for agriculture, their propagation in altered environments, as well as cultural practices used to combat microbial pathogens, may have resulted in the loss in modern cultivars of the endophytes present in their wild ancestors, or such practices may have inadvertently promoted other novel or rare plant-endophyte interactions, or otherwise altered the microbial population. The former is the case in maize and its phylogenetically confirmed, direct wild ancestor, *Parviglumis teosinte* (*Zea mays* ssp. *Parviglumis*). It is possible that this higher diversity and titer of endophytes in the ancestor is correlated with an equally wide range of physiological responses derived from the symbiosis that allow the plant to better adapt to the environment and tolerate stress. In order to survey plant groups for potentially useful endophytes, seeds of their wild ancestors, wild relatives, primitive landraces, modern landraces, modern breeding lines, and elite modern agronomic varieties can be screened for microbial endophytes by culture and culture independent methods as described herein.

In some cases, plants are inoculated with endophytes that are exogenous to the seed of the inoculated plant. In one embodiment, the endophyte is derived from a plant of another species. For example, an endophyte that is normally found in dicots is applied to a monocot plant (e.g., inoculating corn with a soy bean-derived endophyte), or vice versa. In other cases, the endophyte to be inoculated onto a plant can be derived from a related species of the plant that is being inoculated. In one embodiment, the endophyte can be derived from a related taxon, for example, from a related species. The plant of another species can be an agricultural plant. For example, an endophyte derived from *Hordeum irregulare* can be used to inoculate a *Hordeum vulgare* L., plant. Alternatively, it can be derived from a 'wild' plant (i.e., a non-agricultural plant). For example, endophytes normally associated with the wild cotton *Gossypium klotzschianum* can be used to inoculate commercial varieties of *Gossypium hirsutum* plants. As an alternative example of deriving an endophyte from a 'wild' plant, endophytic bacteria isolated from the South East Asian jungle orchid, *Cymbidium eburneum,* can be isolated and testing for their capacity to benefit seedling development and survival of agricultural crops such as wheat, maize, soy and others [Facia, D. C., et al., (2013) *World Journal of Microbiology and Biotechnology.* 29(2). pp. 217-221]. In other cases, the endophyte can be isolated from an ancestral species of the inoculated plant. For example, an endophyte derived from *Zea diploperennis* can be used to inoculate a commercial variety of modern corn, or *Zea mays.*

Relocalization of Endophytes.

While the endophyte that is coated onto the surface of the seed of the first plant is isolated from inside the seed of the second plant, the endophyte can relocalize to other tissues or plant parts once the seed of the first plant germinates. As such, in one embodiment, the seed endophyte which is coated onto the seed of a plant is capable, upon germination of the seed into a vegetative state, of localizing to a different tissue of the plant. For example, the endophyte can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the endophyte is capable of localizing to the root and/or the root hair of the plant. In another embodiment, the endophyte is capable of localizing to the photosynthetic tissues, for example, leaves and shoots of the plant. In other cases, the endophyte is localized to the vascular tissues of the plant, for example, in the xylem and phloem. In still another embodiment, the endophyte is capable of localizing to the reproductive tissues (flower, pollen, pistil, ovaries, stamen, fruit) of the plant. In another embodiment, the endophyte is capable of localizing to the root, shoots, leaves and reproductive tissues of the plant. In still another embodiment, the endophyte colonizes a fruit or seed tissue of the plant. In still another embodiment, the endophyte is able to colonize the plant such that it is present in the surface of the plant (i.e., its presence is detectably present on the plant exterior, or the episphere of the plant). In still other embodiments, the endophyte is capable of localizing to substantially all, or all, tissues of the plant. In certain embodiments, the endophyte is not localized to the root of a plant. In other cases, the endophyte is not localized to the photosynthetic tissues of the plant.

Compositions Comprising Endophytes

In some embodiments, the endophyte is capable of metabolizing D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, and salicin. In one embodiment, the endophyte comprises in its genome a nucleic acid sequence encoding a protein allowing it to metabolize arabinose. In one embodiment, the protein is selected from the group consisting of SEQ ID NO: 3701-3813.

In some embodiments, the plant or plant element experiences an improved ability to grow in water-limited conditions, as a result of being associated with the endophyte or endophyte combinations.

In still another embodiment, the plant element of the first plant can be from a genetically modified plant. In another embodiment, the plant element of the first plant can be a hybrid plant element.

The synthetic combination can comprise a plant element of the first plant which is surface-sterilized prior to combining with the endophytes.

As stated above, the endophyte used in the synthetic combination is derived from a plant element of a second plant. In one embodiment, the second plant is a monocotyledonous plant or tissue thereof. In a particular embodiment, the second plant is a cereal plant or tissue thereof. In yet another embodiment, the second plant is selected from the group consisting of a maize plant, a barley plant, a wheat plant, a sugarcane plant, or a rice plant. In one embodiment, the plant element is a naked grain (i.e., without hulls or fruit cases). In an alternative embodiment, the second plant is a dicotyledonous plant. For example, the second plant can be selected from the group consisting of a cotton plant, a tomato plant, a pepper plant, or a soybean plant.

The synthetic combination can additionally comprise a seed coating composition, a root treatment, or a foliar application composition. The seed coating composition, or the root treatment, or the foliar application composition can comprise an agent selected from the group consisting of: a fungicide, an antibacterial agent, an herbicide, a nematicide, an insecticide, a plant growth regulator, a rodenticide and a nutrient, or a combination thereof. The seed coating composition, or the root treatment, or the foliar application composition can further comprise an agent selected from the group consisting of an agriculturally acceptable carrier, a tackifier, a microbial stabilizer, or a combination thereof. In still another embodiment, the seed coating composition, or the root treatment, or the foliar application composition can contain a second microbial preparation, including but not limited to a rhizobial bacterial preparation.

The present invention contemplates the use of endophytes that are unmodified, as well as those that are modified. In one embodiment, the endophyte is a recombinant endophyte. In one particular embodiment, the endophyte is modified prior to coating onto the surface of the plant element such that it has enhanced compatibility with an antimicrobial agent when compared with the unmodified. For example, the endophyte can be modified such that it has enhanced compatibility with an antibacterial agent. In an alternative embodiment, the endophyte has enhanced compatibility with an antifungal agent. The endophyte can be modified such that it exhibits at least 3 fold greater, for example, at least 5 fold greater, at least 10 fold greater, at least 20 fold greater, at least 30 fold greater or more resistance to an antimicrobial agent when compared with the unmodified endophyte.

The present invention also contemplates the use of multiple endophytes. For example, in one embodiment, the synthetic combination described above can comprise a plurality of purified endophytes, for example, 2, 3, 4 or more different types of endophytes.

In one embodiment, the formulation comprises an endophyte that comprises a nucleic acid sequence that is at least 97% identical, for example, at least 98% identical, at least 99% identical, at least 99.5% identical, or 100% identical, to any nucleic acid selected from SEQ ID NOs: 1-3700.

In one embodiment, the formulation comprises at least two endophytic microbial entities that separately comprise a nucleic acid sequence that is at least 97% identical, for example, at least 98% identical, at least 99% identical, at least 99.5% identical, or 100% identical, to any nucleic acid selected from SEQ ID NOs: 1-3700.

In one embodiment, the agronomic trait is selected from the group consisting of altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome relative to a reference plant. In another embodiment, at least two agronomic traits are improved in the agricultural plant.

In another embodiment, the formulation comprising the endophyte is disposed in an amount effective to detectably increase the rate of germination of the seed. For example, the rate of germination of the seed is increased by at least 0.5%, for example, at least 1%, at least 2%, at least 3%, at least 5%, at least 10%, at least 20%, at least 30%, at least 40%, at least 50%, at least 60%, at least 70%, at least 80%, at least 90%, at least 100% or more, when compared with a reference agricultural plant.

In another embodiment, the formulation comprising the endophyte is disposed in an amount effective to detectably increase the biomass of the plant. For example, the biomass of the plant is detectably increased by at least 1%, for example, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with a reference agricultural plant.

In another embodiment, the formulation comprising the endophyte is disposed in an amount effective to increase the biomass or yield of a fruit or seed of the plant. For example, the biomass of the fruit or seed of the plant is detectably increased by at least 1%, for example, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the fruit or seed of a reference agricultural plant.

In still another embodiment, the formulation comprising the endophyte is disposed in an amount effective to increase the height of the plant. The height of the plant, in some embodiments, is detectably increased by at least 1%, for example, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the height of a reference agricultural plant.

Combinations of Endophytes

In another embodiment, the present invention contemplates methods of associating a plurality of endophytes with one or more plant elements, such as a seed, a leaf, or a root, in order to confer an improved agronomic trait or improved agronomic trait potential to said plant element or host plant.

In some embodiments, the invention contemplates coating the seed of a plant with a plurality of endophytes, as well as seed compositions comprising a plurality of endophytes on and/or in the seed. The methods according to this embodiment can be performed in a manner similar to those described herein for single endophyte coating. In one example, multiple endophytes can be prepared in a single preparation that is coated onto the seed. The endophytes can be from a common origin (i.e., a same plant). Alternatively, the endophytes can be from different plants. Thus, the present invention provides for combinations comprising at least two endophytic microbial populations with an agricultural plant. The endophytic populations are heterologously disposed on an exterior surface of or within the plant in an amount effective to colonize the plant. The combination can further comprise a formulation that comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

Where multiple endophytes are coated onto the seed of the plant, each endophyte can be a bacterium. In the alternative, each endophyte can be a fungus. In still another embodiment, a mixture of bacterial and fungal endophytes can be coated onto the surface of a seed.

In one embodiment, at least two, at least three, at least four, at least five, at least six, at least seven, at least eight, at least night, or at least ten or more endophytes of an endophytic combination is a bacterium selected from one of the following genera: *Acidovorax, Agrobacterium, Bacillus, Burkholderia, Chryseobacterium, Curtobacterium, Enterobacter, Escherichia, Methylobacterium, Paenibacillus, Pantoea, Pseudomonas, Ralstonia, Saccharibacillus, Sphingomonas,* and *Stenotrophomonas.*

In one embodiment, at least two, at least three, at least four, at least five, at least six, at least seven, at least eight, at least night, or at least ten or more endophytes of an endophytic combination is a fungus selected from one of the following genera: *Acremonium, Alternaria, Cladosporium, Cochliobolus, Embellisia, Epicoccum, Fusarium, Nigrospora, Phoma,* and *Podospora.*

In one embodiment, at least two, at least three, at least four, at least five, at least six, at least seven, at least eight, at least night, or at least ten or more endophytes of an endophytic combination is a bacterium selected from one of the following families: Bacillaceae, Burkholderiaceae, Comamonadaceae, Enterobacteriaceae, Flavobacteriaceae, Methylobacteriaceae, Microbacteriaceae, Paenibacillileae, Pseudomonnaceae, Rhizobiaceae, Sphingomonadaceae, Xanthomonadaceae.

In one embodiment, at least two, at least three, at least four, at least five, at least six, at least seven, at least eight, at least night, or at least ten or more endophytes of an endophytic combination is a fungus selected from one of the following families: Cladosporiaceae, Gnomoniaceae, Incertae sedis, Lasiosphaeriaceae, Netriaceae, Pleosporaceae.

In one embodiment, at least two, at least three, at least four, at least five, at least six, at least seven, at least eight, at least night, or at least ten or more endophytes of an endophytic combination are selected from one of the following genera: *Acidovorax, Agrobacterium, Bacillus, Burkholderia, Chryseobacterium, Curtobacterium, Enterobacter, Escherichia, Methylobacterium, Paenibacillus, Pantoea, Pseudomonas, Ralstonia, Saccharibacillus, Sphingomonas,* and *Stenotrophomonas, Acremonium, Alternaria, Cladosporium, Cochliobolus, Embellisia, Epicoccum, Fusarium, Nigrospora, Phoma,* and *Podospora.*

In one embodiment, at least two, at least three, at least four, at least five, at least six, at least seven, at least eight, at least night, or at least ten or more endophytes of an endophytic combination are selected from one of the following families: Bacillaceae, Burkholderiaceae, Comamonadaceae, Enterobacteriaceae, Flavobacteriaceae, Methylobacteriaceae, Microbacteriaceae, Paenibacillileae, Pseudomonnaceae, Rhizobiaceae, Sphingomonadaceae, Xanthomonadaceae, Cladosporiaceae, Gnomoniaceae, Incertae sedis, Lasiosphaeriaceae, Netriaceae, Pleosporaceae.

In one embodiment, at least one of the endophytic populations comprise a nucleic acid that is at least 90% identical, at least 91% identical, at least 92% identical, at least 93% identical, at least 94% identical, at least 95% identical, at least 96% identical, at least 97% identical, at least 98% identical, at least 99% identical, at least 99.5% identical, or 100% identical to a sequence selected from the group consisting of: SEQ ID NOs: 1-3700.

In some embodiments, the combination of endophytes comprises at least two, at least three, at least four, at least five, or greater than five, endophytes, each comprising a nucleic acid sequence selected from the group consisting of SEQ ID NO: 1-3700.

In some embodiments, the combination of endophytes comprises at least two, at least three, at least four, at least five, or greater than five, endophytes, each comprising a nucleic acid sequence at least 80%, at least 85%, at least 90%, at least 92%, at least 93%, at least 94%, at least 95%, at least 96%, at least 97%, at least 98%, at least 99%, or 100% identical from a sequence selected from the group consisting of SEQ ID NO: 1-3700.

In one embodiment, at least two, at least three, at least four, at least five, at least six, at least seven, at least eight, at least night, or at least ten or more endophytes of an endophytic combination is a bacterium comprising in its genome a nucleic acid sequence selected from SEQ ID NOs: 3588, 3589, 3590, 3591, 3592, 3593, 3594, 3595, 3596, 3598, 3599, 3600, 3601, 3603, 3604, 3606, 3607, 3608, 3609, 3619, 3620, 3621, 3622, 3623, 3624, 3625, 3626, 3627, 3628, 3629, 3630, 3631, 3632, 3633, 3634, 3635, 3636, 3637, 3638, 3639, 3641, 3645, 3646, 3648, 3649, 3651, 3652, 3653, 3656, 3663, 3664, 3665, 3666, 3667, 3668, 3669, 3670, 3671. In one embodiment, at least two, at least three, at least four, at least five, at least six, at least seven, at least eight, at least night, or at least ten or more endophytes of an endophytic combination is a fungus comprising in its genome a nucleic acid sequence selected from SEQ ID NOs: 3597, 3602, 3605, 3610, 3611, 3612, 3613, 3614, 3615, 3616, 3617, 3618, 3640, 3642, 3643, 3644, 3647, 3650, 3654, 3655, 3657, 3658, 3659, 3660, 3661, 3662, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700. In one embodiment, at least two, at least three, at least four, at least five, at least six, at least seven, at least eight, at least night, or at least ten or more endophytes of an endophytic combination are endophytes each comprising in its genome a nucleic acid sequence selected from the group consisting of: SEQ ID NOs: 3588, 3589, 3590, 3591, 3592, 3593, 3594, 3595, 3596, 3598, 3599, 3600, 3601, 3603, 3604, 3606, 3607, 3608, 3609, 3619, 3620, 3621, 3622, 3623, 3624, 3625, 3626, 3627, 3628, 3629, 3630, 3631, 3632, 3633, 3634, 3635, 3636, 3637, 3638, 3639, 3641, 3645, 3646, 3648, 3649, 3651, 3652, 3653, 3656, 3663, 3664, 3665, 3666, 3667, 3668, 3669, 3670, 3671, 3597, 3602, 3605, 3610, 3611, 3612, 3613, 3614, 3615, 3616, 3617, 3618, 3640, 3642, 3643, 3644, 3647, 3650, 3654, 3655, 3657, 3658, 3659, 3660, 3661, 3662, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700.

In one embodiment, at least two, at least three, at least four, at least five, at least six, at least seven, at least eight, at least night, or at least ten or more endophytes of an endophytic combination is a bacterium comprising in its genome a nucleic acid that is at least 90% identical, at least 91% identical, at least 92% identical, at least 93% identical, at least 94% identical, at least 95% identical, at least 96% identical, at least 97% identical, at least 98% identical, at least 99% identical, at least 99.5% identical, or 100% identical to a sequence selected from the group consisting of: SEQ ID NOs: 3588, 3589, 3590, 3591, 3592, 3593, 3594, 3595, 3596, 3598, 3599, 3600, 3601, 3603, 3604, 3606, 3607, 3608, 3609, 3619, 3620, 3621, 3622, 3623, 3624, 3625, 3626, 3627, 3628, 3629, 3630, 3631, 3632, 3633, 3634, 3635, 3636, 3637, 3638, 3639, 3641, 3645, 3646, 3648, 3649, 3651, 3652, 3653, 3656, 3663, 3664, 3665, 3666, 3667, 3668, 3669, 3670, 3671. In one embodiment, at least two, at least three, at least four, at least five, at least six, at least seven, at least eight, at least night, or at least ten or more endophytes of an endophytic combination is a fungus comprising in its genome a nucleic acid that is at least 90% identical, at least 91% identical, at least 92% identical, at least 93% identical, at least 94% identical, at least 95% identical, at least 96% identical, at least 97% identical, at least 98% identical, at least 99% identical, at least 99.5% identical, or 100% identical to a sequence selected from the group consisting of: SEQ ID NOs: 3597, 3602, 3605, 3610, 3611, 3612, 3613, 3614, 3615, 3616, 3617, 3618, 3640, 3642, 3643, 3644, 3647, 3650, 3654, 3655, 3657, 3658, 3659, 3660, 3661, 3662, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700. In one embodiment, at least two, at least three, at least four, at least five, at least six, at least seven, at least eight, at least night, or at least ten or more endophytes of an endophytic combination are endophytes each comprising in its genome a nucleic acid that is at least 90% identical, at least 91% identical, at least 92% identical, at least 93% identical, at least 94% identical, at least 95% identical, at least 96% identical, at least 97% identical, at least 98% identical, at least 99% identical, at least 99.5% identical, or 100% identical to a sequence selected from the group consisting of: SEQ ID NOs: 3588, 3589, 3590, 3591, 3592, 3593, 3594, 3595, 3596, 3598, 3599, 3600, 3601, 3603, 3604, 3606, 3607, 3608, 3609, 3619, 3620, 3621, 3622, 3623, 3624, 3625, 3626, 3627, 3628, 3629, 3630, 3631, 3632, 3633, 3634, 3635, 3636, 3637, 3638, 3639, 3641, 3645, 3646, 3648, 3649, 3651, 3652, 3653, 3656, 3663, 3664, 3665, 3666, 3667, 3668, 3669, 3670, 3671, 3597, 3602, 3605, 3610, 3611, 3612, 3613, 3614, 3615, 3616, 3617, 3618, 3640, 3642, 3643, 3644, 3647, 3650, 3654, 3655, 3657, 3658, 3659, 3660, 3661, 3662, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700.

In some aspects, the combination of endophytes comprises at least two endophytes that each comprise at least one nucleic acid sequence that is at least 90% identical, for example, at least 91% identical, at least 92% identical, at least 93% identical, at least 94% identical, at least 95% identical, at least 96% identical, at least 97% identical, at least 98% identical, at least 99% identical, at least 99.5% identical or 100% identical to any nucleic acid provided in Tables 1A, 2A, 3A, 4A, 5-14, 16-23.

In some aspects, the combination of endophytes comprises at least two endophytes provided in any of Tables 2B, 3B, 4B, and 15.

Where multiple endophytes are coated onto the seed, any or all of the endophytes may be capable of conferring a beneficial trait onto the host plant. In some cases, all of the endophytes are capable of conferring a beneficial trait onto the host plant. The trait conferred by each of the endophytes may be the same (e.g., both improve the host plant's tolerance to a particular biotic stress), or may be distinct (e.g., one improves the host plant's tolerance to drought, while another improves phosphate utilization). In other cases the conferred trait may be the result of interactions between the endophytes.

Combinations of endophytes can be selected by any one or more of several criteria. In one embodiment, compatible endophytes are selected. As used herein, "compatibility" refers to endophyte populations that do not significantly interfere with the growth, propagation, and/or production of beneficial substances of the other. Incompatible endophyte populations can arise, for example, where one of the populations produces or secrets a compound that is toxic or deleterious to the growth of the other population(s). Incompatibility arising from production of deleterious compounds/agents can be detected using methods known in the art, and as described herein elsewhere. Similarly, the distinct populations can compete for limited resources in a way that makes co-existence difficult.

In another embodiment, combinations are selected on the basis of compounds produced by each population of endophytes. For example, the first population is capable of producing siderophores, and another population is capable of producing anti-fungal compounds. In one embodiment, the first population of endophytes or endophytic components is capable of a function selected from the group consisting of auxin production, nitrogen fixation, production of an antimicrobial compound, siderophore production, mineral phosphate solubilization, cellulase production, chitinase production, xylanase production, and acetoin production. In another embodiment, the second population of endophytes or endophytic component is capable of a function selected from the group consisting of auxin production, nitrogen fixation, production of an antimicrobial compound, siderophore production, mineral phosphate solubilization, cellulase production, chitinase production, xylanase production, and acetoin production. In still another embodiment, the first and second populations are capable of at least one different function.

In another embodiment, combinations are selected on the basis of carbon sources they metabolize. In some aspects, an endophyte may be capable of using any one or more of the following: 1,2-Propanediol, 2-Aminoethanol, 2-Deoxy adenosine, Acetic acid, Acetoacetic acid, Adenosine, Adonitol, Bromo succinic acid, Citric acid, D-Alanine, D-Aspartic acid, D-Cellobiose, D-Fructose, D-Fructose-6-Phosphate, D-Galactonic acid-γ-lactone, D-Galactose, D-Galacturonic acid, D-Gluconic acid, D-Glucosaminic acid, D-Glucose-1-Phosphate, D-Glucose-6-Phosphate, D-Glucuronic acid, D-L-Malic acid, D-L-α-Glycerol phosphate, D-Malic acid, D-Mannitol, D-Mannose, D-Melibiose, D-Psicose, D-Ribose, D-Saccharic acid, D-Serine, D-Sorbitol, D-Threonine, D-Trehalose, Dulcitol, D-Xylose, Formic acid, Fumaric acid, Glucuronamide, Glycerol, Glycolic acid, Glycyl-L-Aspartic acid, Glycyl-L-Glutamic acid, Glycyl-L-Proline, Glyoxylic acid, Inosine, Lactulose, L-Alanine, L-Alanyl-Glycine, L-Arabinose, L-Asparagine, L-Aspartic acid, L-Fucose, L-Galactonic-acid-α-lactone, L-Glutamic acid, L-glutamine, L-Lactic acid, L-Lyxose, L-Malic acid, L-Proline, L-Rhamnose, L-Serine, L-Threonine, Maltose, Maltotriose, Methyl Pyruvate, m-Hydroxy Phenyl Acetic acid, m-Inositol, Mono Methyl Succinate, m-Tartaric acid, Mucic acid, N-acetyl-β-D-Mannosamine, N-Acetyl-D-Glucosamine, Phenylethylamine, p-Hydroxy Phenyl acetic acid, Propionic acid, Pyruvic acid, Succinic acid, Sucrose, Thymidine, Tricarballylic acid, Tween 20, Tween 40, Tween 80, Tyramine, Uridine, α-D-Glucose, α-D-Lactose, α-Hydroxy Butyric acid, α-Hydroxy Glutaric acid-γ-lactone, α-Keto-Butyric acid, α-Keto-Glutaric acid, α-Methyl-D-Galactoside, β-Methyl-D-glucoside. In preferred embodiments, at least one population is capable of metabolizing any one or more of the following: D-Alanine, D-Aspartic acid, D-Serine, D-ThreonineGlycyl-L-Aspartic acid, Glycyl-L-Glutamic acid, Glycyl-L-Proline, Glyoxylic acid, Inosine, L-Alanine, L-Alanyl-Glycine, L-Arabinose, L-Asparagine, L-Aspartic acid, L-Glutamic acid, L-glutamine, L-Proline, L-Serine, L-Threonine, Tyramine, Uridine, Proline, arabinose, xylose, mannose, sucrose, maltose, D-glucosamine, trehalose, oxalic acid, salicin.

In another aspect, the combination of endophytes comprises at least one endophyte that is capable of metabolizing any one or more of the following: D-Alanine, D-Aspartic acid, D-Serine, D-ThreonineGlycyl-L-Aspartic acid, Glycyl-L-Glutamic acid, Glycyl-L-Proline, Glyoxylic acid, Inosine, L-Alanine, L-Alanyl-Glycine, L-Arabinose, L-Asparagine, L-Aspartic acid, L-Glutamic acid, L-glutamine, L-Proline, L-Serine, L-Threonine, Tyramine, Uridine, Proline, arabinose, xylose, mannose, sucrose, maltose, D-glucosamine, trehalose, oxalic acid, salicin.

For example, one endophyte may be capable of utilizing oxalic acid and a second endophyte may be capable of using arabinose. For example, at least one endophyte may be capable of metabolizing proline, at least one endophyte may be capable of metabolizing mannose. It is contemplated that combinations of endophytes may be selected based on complementary metabolic capabilities: for example, one may be capable of utilizing mannose but not sucrose, and a second may be capable of utilizing sucrose but not mannose. In another aspect, it is contemplated that combinations of endophytes may be selected based on mutual metabolic capabilities: for example, two endophytes that both are able to utilize mannose. In another aspect, it is contemplated that combinations of endophytes are selected based on the synergistic effects of carbon source utilization: for example, one endophyte may have the capability of utilizing mannose but not proline but when in combination with a second endophyte may then display the ability to utilize proline. In other words, one endophyte may be able to promote the ability of another endophyte to utilize a particular carbon source. In another aspect, one endophyte may reduce the ability of another endophyte to utilize a particular carbon source. In another aspect of synergism, two endophytes that are themselves each capable of utilizing one type of carbon source, for example, maltose, may enhance each others' abilities to utilize said carbon source at a greater efficacy. It is contemplated that any combination (mutual, complementary, additive, synergistic) of substrate utilization capabilities may be used as criteria of selection of endophytes of the present invention. It is further contemplated that such combinations of carbon substrate sources for endophyte utilization may include at least two, at least three, at least four, at least five, at least six, at least seven, at least eight, at least nine, at least ten, and even greater than ten different carbon sources.

In some embodiments, the combination of endophytes comprises at least two, at least three, at least four, at least five, or greater than five, endophytes wherein at least one of said endophytes comprises a gene in its genome that encodes a protein selected from the group consisting of: arabinose ABC transporter ATP-binding protein, arabinose ABC transporter permease, arabinose ABC transporter substrate-binding protein, arabinose import ATP-binding protein AraG, arabinose isomerase, arabinose-proton symporter, L-arabinose ABC transporter periplasmic L-arabinose-binding protein, L-arabinose isomerase, L-arabinose transport ATP-binding protein araG, L-arabinose transporter ATP-binding protein, L-arabinose transporter ATP-binding protein (plasmid), L-arabinose transporter permease, L-arabinose transporter permease (plasmid), L-arabinose transporter permease protein, L-arabinose-binding protein, arabinose-proton symporter.

In some embodiments, the combination of endophytes comprises at least two, at least three, at least four, at least five, or greater than five, endophytes wherein each endophyte comprises a gene in its genome that encodes a protein selected from SEQ ID NO: 3701-3913.

In some embodiments, the first endophyte comprises in its genome a gene that encodes a protein with at least 80%, at least 85%, at least 90%, at least 92%, at least 93%, at least 94%, at least 95%, at least 96%, at least 97%, at least 98%, at least 99%, or 100% identical from a sequence selected from the group consisting of SEQ ID NOs: 3701-3913

In some embodiments, the first endophyte comprises in its genome a gene that encodes a protein with at least 80%, at least 85%, at least 90%, at least 92%, at least 93%, at least 94%, at least 95%, at least 96%, at least 97%, at least 98%, at least 99%, or 100% identical from a sequence selected from the group consisting of SEQ ID NOs: 3701-3913, and the second endophyte comprises in its genome a gene that encodes a protein with at least 80% identity to a sequence selected from the group consisting of SEQ ID NOs: 3701-3913.

In some embodiments, the first population comprises in its genome a gene that encodes a protein with at least 80%, at least 85%, at least 90%, at least 95%, at least 96%, at least 97%, at least 98%, or at least 99% identity to a sequence selected from the group consisting of SEQ ID NOs: 3701-3913. In some embodiments, the second population comprises in its genome a gene that encodes a protein with at least 80%, at least 85%, at least 90%, at least 95%, at least 96%, at least 97%, at least 98%, or at least 99% identity to a sequence selected from the group consisting of SEQ ID NOs: 3701-3913.

In some embodiments, the combination of endophytes comprises at least two, at least three, at least four, at least five, or greater than five, endophytes capable of metabolizing at least one of the following: D-Alanine, D-Aspartic acid, D-Serine, D-ThreonineGlycyl-L-Aspartic acid, Glycyl-L-Glutamic acid, Glycyl-L-Proline, Glyoxylic acid, Inosine, L-Alanine, L-Alanyl-Glycine, L-Arabinose, L-Asparagine, L-Aspartic acid, L-Glutamic acid, L-glutamine, L-Proline, L-Serine, L-Threonine, Tyramine, Uridine, Proline, arabinose, xylose, mannose, sucrose, maltose, D-glucosamine, trehalose, oxalic acid, salicin.

In some embodiments, the combination of endophytes comprises at least one endophyte comprising a nucleic acid sequence selected from the group consisting of SEQ ID NO: 1-3700, and at least one endophyte that is capable of metabolizing at least one of D-Alanine, D-Aspartic acid, D-Serine, D-ThreonineGlycyl-L-Aspartic acid, Glycyl-L-Glutamic acid, Glycyl-L-Proline, Glyoxylic acid, Inosine, L-Alanine, L-Alanyl-Glycine, L-Arabinose, L-Asparagine, L-Aspartic acid, L-Glutamic acid, L-glutamine, L-Proline, L-Serine, L-Threonine, Tyramine, Uridine, Proline, arabinose, xylose, mannose, sucrose, maltose, D-glucosamine, trehalose, oxalic acid, salicin.

In another embodiment, the combination of endophytes comprises at least one endophyte comprising a nucleic acid sequence selected from the group consisting of SEQ ID NO: 1-3700, and at least one endophyte that comprises a gene in its genome a gene that encodes a protein selected from SEQ ID NO: 3701-3913.

In another embodiment, the combination of endophytes comprises at least one endophyte that is capable of metabolizing at least one of D-Alanine, D-Aspartic acid, D-Serine, D-ThreonineGlycyl-L-Aspartic acid, Glycyl-L-Glutamic acid, Glycyl-L-Proline, Glyoxylic acid, Inosine, L-Alanine, L-Alanyl-Glycine, L-Arabinose, L-Asparagine, L-Aspartic acid, L-Glutamic acid, L-glutamine, L-Proline, L-Serine, L-Threonine, Tyramine, Uridine, Proline, arabinose, xylose, mannose, sucrose, maltose, D-glucosamine, trehalose, oxalic acid, salicin, and at least one endophyte that comprises a gene in its genome a gene that encodes a protein selected from SEQ ID NO: 3701-3913.

It is contemplated that each endophyte in the combination of endophytes may comprise different characteristics, for example comprise genes with different percent identities to any of the sequences of SEQS ID Nos: 1-3913.

In still another embodiment, the combinations of endophytes are selected for their distinct localization in the plant after colonization. For example, the first population of endophytes or endophytic components can colonize, and in some cases preferentially colonize, the root tissue, while a second population can be selected on the basis of its preferential colonization of the aerial parts of the agricultural plant. Therefore, in one embodiment, the first population is capable of colonizing one or more of the tissues selected from the group consisting of a root, shoot, leaf, flower, and seed. In another embodiment, the second population is capable of colonizing one or more tissues selected from the group consisting of root, shoot, leaf, flower, and seed. In still another embodiment, the first and second populations are capable of colonizing a different tissue within the agricultural plant.

In still another embodiment, combinations of endophytes are selected for their ability to confer one or more distinct agronomic traits on the inoculated agricultural plant, either individually or in synergistic association with other endophytes. Alternatively, two or more endophytes induce the colonization of a third endophyte. For example, the first population of endophytes or endophytic components is selected on the basis that it confers significant increase in biomass, while the second population promotes increased drought tolerance on the inoculated agricultural plant. Therefore, in one embodiment, the first population is capable of conferring at least one trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased tolerance to nitrogen stress, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. In another embodiment, the second population is capable of conferring a trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention. In still another embodiment, each of the first and second population is capable of conferring a different trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention. In any combination of endophytes, any of the following traits of agronomic importance may be modulated due to the association of one or more of the endophytes in the combination with a plant or plant element: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, or a detectable modulation in the proteome relative to a reference plant.

The combinations of endophytes can also be selected based on combinations of the above criteria. For example, the first population of endophytes can be selected on the basis of the compound it produces (e.g., its ability to fix nitrogen, thus providing a potential nitrogen source to the plant), while the second population can be selected on the basis of its ability to confer increased resistance of the plant to a pathogen (e.g., a fungal pathogen).

In some aspects of the present invention, it is contemplated that combinations of endophytes can provide an increased benefit to the host plant, as compared to that conferred by a single endophyte, by virtue of additive effects. For example, one endophyte strain that induces a benefit in the host plant may induce such benefit equally well in a plant that is also colonized with a different endophyte strain that also induces the same benefit in the host plant. The host plant thus exhibits the same total benefit from the plurality of different endophyte strains as the additive benefit to individual plants colonized with each individual endophyte of the plurality. In one example, a plant is colonized with two different endophyte strains: one provides a 1× increase in biomass when associated with the plant, and the other provides a 2× increase in biomass when associated with a different plant. When both endophyte strains are associated with the same plant, that plant would experience a 3× (additive of 1×+2× single effects) increase in auxin biomass. Additive effects are a surprising aspect of the present invention, as non-compatibility of endophytes may result in a cancellation of the beneficial effects of both endophytes.

In some aspects of the present invention, it is contemplated that a combination of endophytes can provide an increased benefit to the host plant, as compared to that conferred by a single endophyte, by virtue of synergistic effects. For example, one endophyte strain that induces a benefit in the host plant may induce such benefit beyond additive effects in a plant that is also colonized with a different endophyte strain that also induces that benefit in the host plant. The host plant thus exhibits the greater total benefit from the plurality of different endophyte strains than would be expected from the additive benefit of individual plants colonized with each individual endophyte of the plurality. In one example, a plant is colonized with two different endophyte strains: one provides a 1× increase in biomass when associated with a plant, and the other provides a 2× increase in biomass when associated with a different plant. When both endophyte strains are associated with the same plant, that plant would experience a 5× (greater than an additive of 1×+2× single effects) increase in biomass. Synergistic effects are a surprising aspect of the present invention.

Selection of Endophytes Conferring Beneficial Traits.

The present invention contemplates inoculation of plants with microbes. As described earlier, the microbes can be derived from many different plants species, from different parts of the plants, and from plants isolated across different environments. Once a microbe is isolated, it can be tested for its ability to confer a beneficial trait. Numerous tests can be performed both in vitro and in vivo to assess what benefits, if any, are conferred upon the plant. In one embodiment, a microbe is tested in vitro for an activity selected from the group consisting of: liberation of complexed phosphates, liberation of complexed iron (e.g., through secretion of siderophores), production of phytohormones, production of antibacterial compounds, production of antifungal compounds, production of insecticidal compounds, production of nematicidal compounds, production and/or secretion of ACC deaminase, production and/or secretion of acetoin, production and/or secretion of pectinase, production and/or secretion of cellulase, and production and/or secretion of RNAse. Exemplary in vitro methods for the above can be found in the Examples sections below.

It is noted that the initial test for the activities listed above can also be performed using a mixture of microbes, for example, a community of microbes isolated from a single plant. A positive activity readout using such mixture can be followed with the isolation of individual microbes within that population and repeating the in vitro tests for the activities to isolate the microbe responsible for the particular activity. Once validated using a single microbe isolate, then the plant can be inoculated with a microbe, and the test performed in vivo, either in growth chamber or greenhouse conditions, and comparing with a control plant that was not inoculated with the microbe.

It is contemplated that each endophyte in the combination of endophytes may comprise different characteristics, for example but not limited to: comprise genes with different percent identities to any of the sequences of SEQS ID Nos: 1-3913, different phenotypic characteristics, different abilities to utilize various carbon sources, different abilities to confer agronomic trait potentials or improved agronomic traits to a host seed or plant to which it may become associated, different localization in plant elements.

Plants Useful for the Present Invention

The methods and compositions according to the present invention can be deployed for any seed plant species. Thus, the invention has use over a broad range of plants, preferably higher plants pertaining to the classes of Angiospermae and Gymnospermae.

In one embodiment, a monocotyledonous plant is used. Monocotyledonous plants belong to the orders of the Alismatales, Arales, Arecales, Bromeliales, Commelinales, Cyclanthales, Cyperales, Eriocaulales, Hydrocharitales, Juncales, Lilliales, Najadales, Orchidales, Pandanales, Poales, Restionales, Triuridales, Typhales, and Zingiberales. Plants belonging to the class of the Gymnospermae are Cycadales, Ginkgoales, Gnetales, and Pinales. In a particular embodiment, the monocotyledonous plant can be selected from the group consisting of a maize, rice, wheat, barley, and sugarcane.

In another embodiment, a dicotyledonous plant is used, including those belonging to the orders of the Aristochiales, Asterales, Batales, Campanulales, Capparales, Caryophyllales, Casuarinales, Celastrales, Cornales, Diapensales, Dilleniales, Dipsacales, Ebenales, Ericales, Eucomiales, Euphorbiales, Fabales, Fagales, Gentianales, Geraniales, Haloragales, Hamamelidales, Middles, Juglandales, Lamiales, Laurales, Lecythidales, Leitneriales, Magniolales, Malvales, Myricales, Myrtales, Nymphaeales, Papeverales, Piperales, Plantaginales, Plumb aginales, Podostemales, Polemoniales, Polygalales, Polygonales, Primulales, Proteales, Rafflesiales, Ranunculales, Rhamnales, Rosales, Rubiales, Salicales, Santales, Sapindales, Sarraceniaceae, Scrophulariales, Theales, Trochodendrales, Umbellales, Urticales, and Violates. In a particular embodiment, the dicotyledonous plant can be selected from the group consisting of cotton, soybean, pepper, and tomato.

The present invention contemplates the use of endophytic microbial entities derived from plants. It is contemplated that the plants may be agricultural plants. In some embodiments, a cultivar or variety that is of the same family as the plant from which the endophyte is derived is used. In some embodiments, a cultivar or variety that is of the same genus as the plant from which the endophyte is derived is used. In some embodiments, a cultivar or variety that is of the same species as the ancestral plant from which the endophyte is derived is used. In some embodiments, a modern cultivar or variety that is of the same family as the ancestral plant from which the endophyte is derived is used. In another embodiment, a modern cultivar or variety that is of the same genus as the ancestral plant from which the endophyte is used. In still another embodiment, a modern cultivar or variety that is of the same species as the ancestral plant from which the endophyte is used.

The methods and compositions of the present invention are preferably used in plants that are important or interesting for agriculture, horticulture, biomass for the production of biofuel molecules and other chemicals, and/or forestry. Non-limiting examples include, for instance, *Panicum virgatum* (switch), *Sorghum bicolor* (sorghum, sudan), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp., *Sorghum* spp., *Miscanthus* spp., *Saccharum* spp., *Erianthus* spp., *Populus* spp., *Secale cereale* (rye), *Salix* spp. (willow), *Eucalyptus* spp. (*eucalyptus*), *Triticosecale* spp. (*triticum*—wheat X rye), Bamboo, *Carthamus tinctorius* (safflower), *Jatropha curcas* (Jatropha), *Ricinus communis* (castor), *Elaeis guineensis* (oil palm), *Phoenix dactylifera* (date palm), *Archontophoenix cunninghamiana* (king palm), *Syagrus romanzoffiana* (queen palm), *Linum usitatissimum* (flax), *Brassica juncea, Manihot esculenta* (cassava), *Lycopersicon esculentum* (tomato), *Lactuca* saliva (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis* saliva, *Camptotheca acuminate, Catharanthus roseus, Vinca rosea, Cinchona officinalis, Coichicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (*petunia*), *Poinsettia pulcherrima* (*poinsettia*), *Nicotiana tabacum* (tobacco), *Lupinus albus* (lupin), *Uniola paniculata* (oats), *Hordeum vulgare* (barley), and *Lolium* spp. (rye).

The present invention contemplates improving an agronomic trait in an agricultural plant by contacting a modern agricultural plant with a formulation comprising an endophyte derived from a plant or an endophyte conserved across diverse species and/or cultivars of agricultural plants. In one embodiment, the modern agricultural plant is a hybrid plant. In another embodiment, the modern agricultural plant is an inbred plant. Non-limiting examples of such hybrid, inbred and genetically modified plants are described below. In still another embodiment the modern agricultural plant is a genetically modified plant. The methods described herein can also be used with genetically modified plants, for example, to yield additional trait benefits to a plant. In one embodiment, the modern agricultural plant is a genetically modified plant that comprises a transgene that confers in the plant a phenotype selected from the group consisting of: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, a detectable modulation in the proteome relative to a reference plant, or any combination thereof.

Plant Element and Endophyte Combinations

It is contemplated that the methods and compositions of the present invention may be used to improve any characteristic of any agricultural plant. The methods described herein can also be used with transgenic plants comprising one or more exogenous transgenes, for example, to yield additional trait benefits conferred by the newly introduced endophytic microbes. Therefore, in one embodiment, a plant element of a transgenic maize, wheat, rice, cotton, canola, alfalfa, or barley plant is contacted with an endophytic microbe.

The presence of the endophyte or other microbes can be detected and its localization in or on the host plant (including a plant element thereof) can be determined using a number of different methodologies. The presence of the microbe in the embryo or endosperm, as well as its localization with respect to the plant cells, can be determined using methods known in the art, including immunofluorescence microscopy using microbe specific antibodies, or fluorescence in situ hybridization (see, for example, Amann et al. (2001) Current Opinion in Biotechnology 12:231-236, incorporated herein by reference). The presence and quantity of other microbes can be established by the FISH, immunofluorescence and PCR methods using probes that are specific for the microbe. Alternatively, degenerate probes recognizing conserved sequences from many bacteria and/or fungi can be employed to amplify a region, after which the identity of the microbes present in the tested tissue/cell can be determined by sequencing.

In some embodiments, the present invention contemplates the use of endophytes that can confer a beneficial agronomic trait upon the plant element or resulting plant with which it is associated.

In some cases, the endophytes described herein are capable of moving from one tissue type to another. For example, the present invention's detection and isolation of endophytes within the mature tissues of plants after coating on the exterior of a seed demonstrates their ability to move from seed exterior into the vegetative tissues of a maturing plant. Therefore, in one embodiment, the population of endophytes is capable of moving from the seed exterior into the vegetative tissues of a plant. In one embodiment, the endophyte that is coated onto the seed of a plant is capable, upon germination of the seed into a vegetative state, of localizing to a different tissue of the plant. For example, endophytes can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the endophyte is capable of localizing to the root and/or the root hair of the plant. In another embodiment, the endophyte is capable of localizing to the photosynthetic tissues, for example, leaves and shoots of the plant. In other cases, the endophyte is localized to the vascular tissues of the plant, for example, in the xylem and phloem. In still another embodiment, the endophyte is capable of localizing to the reproductive tissues (flower, pollen, pistil, ovaries, stamen, fruit) of the plant. In another embodiment, the endophyte is capable of localizing to the root, shoots, leaves and reproductive tissues of the plant. In still another embodiment, the endophyte colonizes a fruit or seed tissue of the plant. In still another embodiment, the endophyte is able to colonize the plant such that it is present in the surface of the plant (i.e., its presence is detectably present on the plant exterior, or the epishere of the plant). In still other embodiments, the endophyte is capable of localizing to substantially all, or all, tissues of the plant. In certain embodiments, the endophyte is not localized to the root of a plant. In other cases, the endophyte is not localized to the photosynthetic tissues of the plant.

In some cases, endophytes are capable of replicating within the host plant and colonizing the plant.

In another aspect, the present invention provides for combinations of endophytic microbial entities and plants. The endophytic microbial entities described herein are unique in that they have been isolated from seeds of plants (e.g., an agricultural plant, for example a seed or seedling or an agricultural plant, comprising a population of endophytic microbial entities that is heterologously disposed on an exterior surface of or within the seed or seedling in an amount effective to colonize the plant). The combination can further comprise a formulation that comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient. In some embodiments, the population of endophytic bacteria are present in an amount effective to provide a benefit to an agricultural plant derived from an agricultural seed or seedling to which the formulation is administered.

The population of endophytic microbial entities comprises a nucleic acid sequence that is at least 95%, at least 96%, at least 97% identical, for example, at least 98%, at least 99%, at least 99.5% identical, 99.8% identical, or 100% identical, to a nucleic acid sequence selected from the group consisting of SEQ ID NOs: 1-3700. In another embodiment, the endophyte comprises a nucleic acid sequence that is at least 99% identical to a nucleic acid sequence selected from the group consisting of SEQ ID NOs: 1-3700. In still another embodiment, the endophyte comprises a nucleic acid sequence that is identical to a nucleic acid sequence selected from the group consisting of SEQ ID NOs: 1-3700.

In some embodiments, disclosed is a seed of an agricultural plant comprising an exogenous population of an endophyte that is disposed on an exterior surface of or within the plant in an amount effective to colonize the plant. The population is considered exogenous to the seed if that particular seed does not inherently contain the population of endophytic microbial entities.

In other cases, the present invention discloses a seed of an agricultural plant comprising a population of endophytic microbial entities that is heterologously disposed on an exterior surface of or within the plant in an amount effective to colonize the plant. For example, the population of endophytic microbial entities that is disposed on an exterior surface or within the seed can be an endophyte that may be associated with the mature plant, but is not found on the surface of or within the seed. Alternatively, the population can be found in the surface of, or within the seed, but at a much lower number than is disposed.

As shown in the Examples section below, the endophytic populations described herein are capable of colonizing the host plant. In certain cases, the endophytic population can be applied to the plant, for example the plant seed, or by foliar application, and successful colonization can be confirmed by detecting the presence of the endophytic microbial population within the plant. For example, after applying the endophyte to the seeds, high titers of the endophyte can be detected in the roots and shoots of the plants that germinate from the seeds. In addition, significant quantities of the endophyte can be detected in the rhizosphere of the plants. Therefore, in one embodiment, the endophytic microbe population is disposed in an amount effective to colonize the plant. Colonization of the plant can be detected, for example, by detecting the presence of the endophytic microbe inside the plant. This can be accomplished by measuring the viability of the microbe after surface sterilization of the seed or the plant: endophytic colonization results in an internal localization of the microbe, rendering it resistant to conditions of surface sterilization. The presence and quantity of the microbe can also be established using other means known in the art, for example, immunofluorescence microscopy using microbe specific antibodies, or fluorescence in situ hybridization (see, for example, Amann et al. (2001) Current Opinion in Biotechnology 12:231-236, incorporated herein by reference in its entirety). Alternatively, specific nucleic acid probes recognizing conserved sequences from the endophytic bacterium can be employed to amplify a region, for example by quantitative PCR, and correlated to CFUs by means of a standard curve.

In another embodiment, the endophytic microbe is disposed, for example, on the surface of a seed of an agricultural plant, in an amount effective to be detectable in the mature agricultural plant. In one embodiment, the endophytic microbe is disposed in an amount effective to be detectable in an amount of at least about 100 CFU or spores, at least about 200 CFU or spores, at least about 300 CFU or spores, at least about 500 CFU or spores, at least about 1,000 CFU or spores, at least about 3,000 CFU or spores, at least about 10,000 CFU or spores, at least about 30,000 CFU or spores, at least about 100,000 CFU or spores, at least about $10^6$ CFU or spores or more in the mature agricultural plant.

In some cases, the endophytic microbe is capable of colonizing particular tissue types of the plant. In one embodiment, the endophytic microbe is disposed on the seed or seedling in an amount effective to be detectable within a target tissue of the mature agricultural plant selected from a fruit, a seed, a leaf, or a root, or portion thereof. For example, the endophytic microbe can be detected in an amount of at least about 100 CFU or spores, at least about 200 CFU or spores, at least about 300 CFU or spores, at least about 500 CFU or spores, at least about 1,000 CFU or spores, at least about 3,000 CFU or spores, at least about 10,000 CFU or spores, at least about 30,000 CFU or spores, at least about 100,000 CFU or spores, at least about $10^6$ CFU or spores or more, in the target tissue of the mature agricultural plant.

In some cases, the microbes disposed on the seed or seedling can be detected in the rhizosphere. This may be due to successful colonization by the endophytic microbe, where certain quantities of the microbe is shed from the root, thereby colonizing the rhizosphere. In some cases, the rhizosphere-localized microbe can secrete compounds (such as siderophores or organic acids) which assist with nutrient acquisition by the plant. Therefore, in another embodiment, the endophytic microbe is disposed on the surface of the seed in an amount effective to detectably colonize the soil environment surrounding the mature agricultural plant when compared with a reference agricultural plant. For example, the microbe can be detected in an amount of at least 100 CFU or spores/g DW, for example, at least 200 CFU or spores/g DW, at least 500 CFU or spores/g DW, at least 1,000 CFU or spores/g DW, at least 3,000 CFU or spores/g DW, at least 10,000 CFU or spores/g DW, at least 30,000 CFU or spores/g DW, at least 100,000 CFU or spores/g DW, at least 300,000 CFU or spores/g DW, or more, in the rhizosphere.

The populations of endophytic microbial entities described herein are also capable of providing many agronomic benefits to the host plant. As shown in the Examples section, endophyte-inoculated plants display increased seed germination, increased vigor, increased biomass (e.g., increased root or shoot biomass). Therefore, in one embodiment, the population is disposed on the surface or within a tissue of the seed or seedling in an amount effective to increase the biomass of the plant, or a part or tissue of the plant grown from the seed or seedling.

The increased biomass is useful in the production of commodity products derived from the plant. Such commodity products include an animal feed, a fish fodder, a cereal product, a processed human-food product, a sugar or an alcohol. Such products may be a fermentation product or a fermentable product, one such exemplary product is a biofuel. The increase in biomass can occur in a part of the plant (e.g., the root tissue, shoots, leaves, etc.), or can be an increase in overall biomass. Increased biomass production, such an increase meaning at least about 10%, 20%, 30%, 40%, 50%, 60%, 70%, 80%, 90%, 100%, or greater than 100% when compared with a reference agricultural plant. Such increase in overall biomass can be under relatively stress-free conditions. In other cases, the increase in biomass can be in plants grown under any number of abiotic or biotic stresses, including drought stress, salt stress, heat stress, cold stress, low nutrient stress, nematode stress, insect herbivory stress, fungal pathogen stress, bacterial pathogen stress, and viral pathogen stress. In one particular embodiment, the endophytic microbial population is disposed in an amount effective to increase root biomass by at least 10%, for example, at least 20%, at least 30%, at least 40%, at least 50%, at least 60%, at least 75%, at least 100%, or more, when compared with a reference agricultural plant.

In another embodiment, the endophytic microbial population is disposed on the surface or within a tissue of the seed or seedling in an amount effective to increase the rate of seed germination when compared with a reference agricultural plant. For example, the increase in seed germination can be at least 2%, at least 3%, at least 4%, at least 5%, at least 6%, at least 7%, at least 8%, at least 9%, at least 10%, at least 15%, for example, at least 20%, at least 30%, at least 40%, at least 50%, at least 60%, at least 75%, at least 100%, or more, when compared with a reference agricultural plant.

In other cases, the endophytic microbe is disposed on the seed or seedling in an amount effective to increase the average biomass of the fruit or cob from the resulting plant by at least 2%, at least 3%, at least 4%, at least 5%, at least 6%, at least 7%, at least 8%, at least 9%, at least 10%, at least 15%, for example, at least 20%, at least 30%, at least 40%, at least 50%, at least 75%, at least 100% or more, when compared with a reference agricultural plant.

In some cases, plants are inoculated with endophytes that are isolated from the same species of plant as the plant element of the inoculated plant. For example, an endophyte that is normally found in one variety of Zea mays (corn) is associated with a plant element of a plant of another variety of Zea mays that in its natural state lacks said endophyte. In one embodiment, the endophyte is derived from a plant of a related species of plant as the plant element of the inoculated plant. For example, an endophyte that is normally found in Zea diploperennis Iltis et al., (diploperennial teosinte) is applied to a Zea mays (corn), or vice versa. In some cases, plants are inoculated with endophytes that are heterologous to the plant element of the inoculated plant. In one embodiment, the endophyte is derived from a plant of another species. For example, an endophyte that is normally found in dicots is applied to a monocot plant (e.g., inoculating corn with a soybean-derived endophyte), or vice versa. In other cases, the endophyte to be inoculated onto a plant is derived from a related species of the plant that is being inoculated. In one embodiment, the endophyte is derived from a related taxon, for example, from a related species. The plant of another species can be an agricultural plant. In another embodiment, the endophyte is part of a designed composition inoculated into any host plant element.

As highlighted in the Examples section, plants inoculated with the endophytic microbial population also show an increase in overall plant height. Therefore, in one embodiment, the present invention provides for a seed comprising an endophytic microbial population which is disposed on the surface or within a tissue of the seed or seedling in an amount effective to increase the height of the plant. For example, the endophytic microbial population is disposed in an amount effective to result in an increase in height of the agricultural plant such that is at least 10% greater, for example, at least 20% greater, at least 30% greater, at least 40% greater, at least 50% greater, at least 60% greater, at least 70% greater, at least 80% greater, at least 90% greater, at least 100% greater, at least 125% greater, at least 150% greater or more, when compared with a reference agricultural plant, the plant. Such increase in height can be under relatively stress-free conditions. In other cases, the increase in height can be in plants grown under any number of abiotic or biotic stresses, including drought stress, salt stress, heat stress, cold stress, low nutrient stress, nematode stress, insect herbivory stress, fungal pathogen stress, bacterial pathogen stress, and viral pathogen stress.

The host plants inoculated with the endophytic microbial population also show dramatic improvements in their ability to utilize water more efficiently. Water use efficiency is a parameter often correlated with drought tolerance. Water use efficiency (WUE) is a parameter often correlated with drought tolerance, and is the CO2 assimilation rate per water transpired by the plant. An increase in biomass at low water availability may be due to relatively improved efficiency of growth or reduced water consumption. In selecting traits for improving crops, a decrease in water use, without a change in growth would have particular merit in an irrigated agricultural system where the water input costs were high. An increase in growth without a corresponding jump in water use would have applicability to all agricultural systems. In many agricultural systems where water supply is not limiting, an increase in growth, even if it came at the expense of an increase in water use also increases yield.

When soil water is depleted or if water is not available during periods of drought, crop yields are restricted. Plant water deficit develops if transpiration from leaves exceeds the supply of water from the roots. The available water supply is related to the amount of water held in the soil and the ability of the plant to reach that water with its root system. Transpiration of water from leaves is linked to the fixation of carbon dioxide by photosynthesis through the stomata. The two processes are positively correlated so that high carbon dioxide influx through photosynthesis is closely linked to water loss by transpiration. As water transpires from the leaf, leaf water potential is reduced and the stomata tend to close in a hydraulic process limiting the amount of photosynthesis. Since crop yield is dependent on the fixation of carbon dioxide in photosynthesis, water uptake and transpiration are contributing factors to crop yield. Plants which are able to use less water to fix the same amount of carbon dioxide or which are able to function normally at a lower water potential have the potential to conduct more photosynthesis and thereby to produce more biomass and economic yield in many agricultural systems. An increased water use efficiency of the plant relates in some cases to an increased fruit/kernel size or number.

Therefore, in one embodiment, the plants described herein exhibit an increased water use efficiency when compared with a reference agricultural plant grown under the same conditions. For example, the plants grown from the seeds comprising the endophytic microbial population can have at least 5% higher WUE, for example, at least 10% higher, at least 20% higher, at least 30% higher, at least 40% higher, at least 50% higher, at least 60% higher, at least 70% higher, at least 80% higher, at least 90% higher, at least 100% higher WUE than a reference agricultural plant grown under the same conditions. Such an increase in WUE can occur under conditions without water deficit, or under conditions of water deficit, for example, when the soil water content is less than or equal to 60% of water saturated soil, for example, less than or equal to 50%, less than or equal to 40%, less than or equal to 30%, less than or equal to 20%, less than or equal to 10% of water saturated soil on a weight basis.

In a related embodiment, the plant comprising the endophytic microbial population can have at least 10% higher relative water content (RWC), for example, at least 20% higher, at least 30% higher, at least 40% higher, at least 50% higher, at least 60% higher, at least 70% higher, at least 80% higher, at least 90% higher, at least 100% higher RWC than a reference agricultural plant grown under the same conditions.

Many of the microbes described herein are capable of producing the plant hormone auxin indole-3-acetic acid (IAA) when grown in culture. Auxin may play a key role in altering the physiology of the plant, including the extent of root growth. Therefore, in another embodiment, the endophytic microbial population is disposed on the surface or within a tissue of the seed or seedling in an amount effective to detectably induce production of auxin in the agricultural plant. For example, the increase in auxin production can be at least 2%, at least 3%, at least 4%, at least 5%, at least 6%, at least 7%, at least 8%, at least 9%, at least 10%, at least 15%, for example, at least 20%, at least 30%, at least 40%, at least 50%, at least 60%, at least 75%, at least 100%, or more, when compared with a reference agricultural plant. In one embodiment, the increased auxin production can be detected in a tissue type selected from the group consisting of the root, shoot, leaves, and flowers.

In another embodiment, the endophytic population of the present invention can cause a detectable modulation in the amount of a metabolite in the plant or part of the plant. Such modulation can be detected, for example, by measuring the levels of a given metabolite and comparing with the levels of the metabolite in a reference agricultural plant grown under the same conditions.

Formulations for Agricultural Use

The present invention contemplates a synthetic combination of a plant element that is associated with an endophyte to confer an improved trait of agronomic importance to the host plant, or an improved agronomic trait potential to a plant element associated with the endophyte, that upon and after germination will confer said benefit to the resultant host plant.

In some embodiments, the plant element is associated with an endophyte on its surface. Such association is contemplated to be via a mechanism selected from the group consisting of: spraying, immersion, coating, encapsulating, dusting, dripping, aerosolizing.

In some embodiments, the plant element is a leaf, and the synthetic combination is formulated for application as a foliar treatment.

In some embodiments, the plant element is a seed, and the synthetic combination is formulated for application as a seed coating.

In some embodiments, the plant element is a root, and the synthetic combination is formulated for application as a root treatment.

In certain embodiments, the plant element becomes associated with the endophyte(s) through delayed exposure. For example, the soil in which a plant element is to be introduced is first treated with a composition comprising the endophyte or combination of endophytes. In another example, the area around the plant or plant element is exposed to a formulation comprising the endophyte(s), and the plant element becomes subsequently associated with the endophyte(s) due to movement of soil, air, water, insects, mammals, human intervention, or other methods.

The plant element can be obtained from any agricultural plant. In one embodiment, the plant element of the first plant is from a monocotyledonous plant. For example, the plant element of the first plant is from a cereal plant. The plant element of the first plant can be selected from the group consisting of a maize seed, a wheat seed, a barley seed, a rice seed, a sugarcane seed, a maize root, a wheat root, a barley root, a sugarcane root, a rice root, a maize leaf, a wheat leaf, a barley leaf, a sugarcane leaf, or a rice leaf. In an alternative embodiment, the plant element of the first plant is from a dicotyledonous plant. The plant element of the first plant can be selected from the group consisting of a cotton seed, a tomato seed, a canola seed, a pepper seed, a soybean seed, a cotton root, a tomato root, a canola root, a pepper root, a soybean root, a cotton leaf, a tomato leaf, a canola leaf, a pepper leaf, or a soybean leaf. In still another embodiment, the plant element of the first plant can be from a genetically modified plant. In another embodiment, the plant element of the first plant can be a hybrid plant element.

The synthetic combination can comprise a plant element of the first plant which is surface-sterilized prior to combining with the endophytes. Such pre-treatment prior to coating the seed with endophytes removes the presence of other microbes which may interfere with the optimal colonization, growth and/or function of the endophyte. Surface sterilization of seeds can be accomplished without killing the seeds as described herein.

The endophyte populations described herein are intended to be useful in the improvement of agricultural plants, and as such, may be formulated with other compositions as part of an agriculturally compatible carrier. It is contemplated that such carriers can include, but not be limited to: seed treatment, root treatment, foliar treatment, soil treatment. The carrier composition with the endophyte populations, may be prepared for agricultural application as a liquid, a solid, or a gas formulation. Application to the plant may be achieved, for example, as a powder for surface deposition onto plant leaves, as a spray to the whole plant or selected plant element, as part of a drip to the soil or the roots, or as a coating onto the seed prior to planting. Such examples are meant to be illustrative and not limiting to the scope of the invention.

In some embodiments, the present invention contemplates plant elements comprising a endophytic microbial population, and further comprising a formulation. The formulation useful for these embodiments generally comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

In some cases, the endophytic population is mixed with an agriculturally compatible carrier. The carrier can be a solid carrier or liquid carrier. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in a composition of the invention. Water-in-oil emulsions can also be used to formulate a composition that includes the endophytic population of the present invention (see, for example, U.S. Pat. No. 7,485,451, which is incorporated herein by reference in its entirety). Suitable formulations that may be prepared include wettable powders, granules, gels, agar strips or pellets, thickeners, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or plant growth medium. Other agricultural carriers that may be used include fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pesta (flour and kaolin clay), agar or flour-based pellets in loam, sand, or clay, etc. Formulations may include food sources for the cultured organisms, such as barley, rice, or other biological materials such as seed, leaf, root, plant elements, sugar cane bagasse, hulls or stalks from grain processing, ground plant material or wood from building site refuse, sawdust or small fibers from recycling of paper, fabric, or wood. Other suitable formulations will be known to those skilled in the art.

In one embodiment, the formulation can comprise a tackifier or adherent. Such agents are useful for combining the microbial population of the invention with carriers that can contain other compounds (e.g., control agents that are not biologic), to yield a coating composition. Such compositions help create coatings around the plant or plant element to maintain contact between the microbe and other agents with the plant or plant part. In one embodiment, adherents are selected from the group consisting of: alginate, gums, starches, lecithins, formononetin, polyvinyl alcohol, alkali formononetinate, hesperetin, polyvinyl acetate, cephalins, Gum Arabic, Xanthan Gum, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers. Other examples of adherent compositions that can be used in the synthetic preparation include those described in EP 0818135, CA 1229497, WO 2013090628, EP 0192342, WO 2008103422 and CA 1041788, each of which is incorporated herein by reference in its entirety.

The formulation can also contain a surfactant. Non-limiting examples of surfactants include nitrogen-surfactant blends such as Prefer 28 (Cenex), Surf-N (US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision). In one embodiment, the surfactant is present at a concentration of between 0.01% v/v to 10% v/v. In another embodiment, the surfactant is present at a concentration of between 0.1% v/v to 1% v/v.

In certain cases, the formulation includes a microbial stabilizer. Such an agent can include a desiccant. As used herein, a "desiccant" can include any compound or mixture of compounds that can be classified as a desiccant regardless of whether the compound or compounds are used in such concentrations that they in fact have a desiccating effect on the liquid inoculant. Such desiccants are ideally compatible with the endophytic population used, and should promote the ability of the microbial population to survive application on the plant elements and to survive desiccation. Examples of suitable desiccants include one or more of trehalose, sucrose, glycerol, and Methylene glycol. Other suitable desiccants include, but are not limited to, non-reducing sugars and sugar alcohols (e.g., mannitol or sorbitol). The amount of desiccant introduced into the formulation can range from about 5% to about 50% by weight/volume, for example, between about 10% to about 40%, between about 15% and about 35%, or between about 20% and about 30%.

In some cases, it is advantageous for the formulation to contain agents such as a fungicide, an antibacterial agent, an herbicide, a nematicide, an insecticide, a plant growth regulator, a rodenticide, and a nutrient. Such agents are ideally compatible with the agricultural plant element or seedling onto which the formulation is applied (e.g., it should not be deleterious to the growth or health of the plant). Furthermore, the agent is ideally one which does not cause safety concerns for human, animal or industrial use (e.g., no safety issues, or the compound is sufficiently labile that the commodity plant product derived from the plant contains negligible amounts of the compound).

In the liquid form, for example, solutions or suspensions, the endophytic microbial populations of the present invention can be mixed or suspended in aqueous solutions. Suitable liquid diluents or carriers include aqueous solutions, petroleum distillates, or other liquid carriers.

Solid compositions can be prepared by dispersing the endophytic microbial populations of the invention in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils such as soybean oil and cottonseed oil, glycerol, ethylene glycol, polyethylene glycol, propylene glycol, polypropylene glycol, etc.

In one particular embodiment, the formulation is ideally suited for coating of the endophytic microbial population onto plant elements. The endophytic microbial populations described in the present invention are capable of conferring many agronomic benefits to the host plants. The ability to confer such benefits by coating the endophytic microbial populations on the surface of plant elements has many potential advantages, particularly when used in a commercial (agricultural) scale.

The endophytic microbial populations herein can be combined with one or more of the agents described above to yield a formulation suitable for combining with an agricultural plant element or seedling. The endophytic microbial population can be obtained from growth in culture, for example, using a synthetic growth medium. In addition, the microbe can be cultured on solid media, for example on petri dishes, scraped off and suspended into the preparation. Microbes at different growth phases can be used. For example, microbes at lag phase, early-log phase, mid-log phase, late-log phase, stationary phase, early death phase, or death phase can be used.

The formulations comprising the endophytic microbial population of the present invention typically contains between about 0.1 to 95% by weight, for example, between about 1% and 90%, between about 3% and 75%, between about 5% and 60%, between about 10% and 50% in wet weight of the endophytic population of the present invention. It is preferred that the formulation contains at least about $10^2$ per ml of formulation, at least about $10^3$ per ml of formulation, for example, at least about $10^4$, at least about $10^5$, at least about $10^6$, at least about $10^7$ CFU or spores, at least about $10^8$ CFU or spores per ml of formulation.

As described above, in certain embodiments, the present invention contemplates the use of endophytic bacteria and/or fungi that are heterologously disposed on the plant, for example, the plant element. In certain cases, the agricultural plant may contain bacteria that are substantially similar to, or even genetically indistinguishable from, the bacteria that are being applied to the plant. It is noted that, in many cases, the bacteria that are being applied is substantially different from the bacteria already present in several significant ways. First, the bacteria that are being applied to the agricultural plant have been adapted to culture, or adapted to be able to grow on growth media in isolation from the plant. Second, in many cases, the bacteria that are being applied are derived from a clonal origin, rather than from a heterologous origin and, as such, can be distinguished from the bacteria that are already present in the agricultural plant by the clonal similarity. For example, where a microbe that has been inoculated by a plant is also present in the plant (for example, in a different tissue or portion of the plant), or where the introduced microbe is sufficiently similar to a microbe that is present in some of the plants (or portion of the plant, including plant elements), it is still possible to distinguish between the inoculated microbe and the native microbe by distinguishing between the two microbe types on the basis of their epigenetic status (e.g., the bacteria that are applied, as well as their progeny, would be expected to have a much more uniform and similar pattern of cytosine methylation of its genome, with respect to the extent and/or location of methylation).

Endophytes Compatible with Agrichemicals

In certain embodiments, the endophyte is selected on the basis of its compatibility with commonly used agrichemicals. As mentioned earlier, plants, particularly agricultural plants, can be treated with a vast array of agrichemicals, including fungicides, biocides (anti-complex agents), herbicides, insecticides, nematicides, rodenticides, fertilizers, and other agents.

In some cases, it can be important for the endophyte to be compatible with agrichemicals, particularly those with anti-complex properties, in order to persist in the plant although, as mentioned earlier, there are many such anticomplex agents that do not penetrate the plant, at least at a concentration sufficient to interfere with the endophyte. Therefore, where a systemic anticomplex agent is used in the plant, compatibility of the endophyte to be inoculated with such agents will be an important criterion.

Fungicides.

In one embodiment, the control agent is a fungicide. As used herein, a fungicide is any compound or agent (whether chemical or biological) that can either inhibit the growth of a fungus or kill a fungus. In that sense, a "fungicide", as used herein, encompasses compounds that may be fungistatic or fungicidal. As used herein, the fungicide can be a protectant, or agents that are effective predominantly on the seed surface, providing protection against seed surface-borne pathogens and providing some level of control of soil-borne pathogens. Non-limiting examples of protectant fungicides include captan, maneb, thiram, or fludioxonil.

The fungicide can be a systemic fungicide, which can be absorbed into the emerging seedling and inhibit or kill the fungus inside host plant tissues. Systemic fungicides used for seed treatment include, but are not limited to the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the water mold fungi *Pythium* and *Phytophthora*. Some fungicides are preferred over others, depending on the plant species, either because of subtle differences in sensitivity of the pathogenic fungal species, or because of the differences in the fungicide distribution or sensitivity of the plants.

A fungicide can be a biological control agent, such as a bacterium or fungus. Such organisms may be parasitic to the pathogenic fungi, or secrete toxins or other substances which can kill or otherwise prevent the growth of fungi. Any type of fungicide, particularly ones that are commonly used on plants, can be used as a control agent in a seed composition.

Antibacterial Agents.

In some cases, the seed coating composition comprises a control agent which has antibacterial properties. In one embodiment, the control agent with antibacterial properties is selected from the compounds described herein elsewhere. In another embodiment, the compound is Streptomycin, oxytetracycline, oxolinic acid, or gentamicin.

Plant Growth Regulators.

The seed coat composition can further comprise a plant growth regulator. In one embodiment, the plant growth regulator is selected from the group consisting of: Abscisic acid, amidochlor, ancymidol, 6-benzylaminopurine, brassinolide, butralin, chlormequat (chlormequat chloride), choline chloride, cyclanilide, daminozide, dikegulac, dimethipin, 2,6-dimethylpuridine, ethephon, flumetralin, flurprimidol, fluthiacet, forchlorfenuron, gibberellic acid, inabenfide, indole-3-acetic acid, maleic hydrazide, mefluidide, mepiquat (mepiquat chloride), naphthaleneacetic acid, N-6-benzyladenine, paclobutrazol, prohexadione (prohexadione-calcium), prohydrojasmon, thidiazuron, triapenthenol, tributyl phosphorotrithioate, 2,3,5-tri-iodobenzoic acid, trinexapac-ethyl and uniconazole. Other examples of antibacterial compounds which can be used as part of a seed coating composition include those based on dichlorophene and benzylalcohol hemi formal (Proxel® from ICI or Acticide® RS from Thor Chemie and Kathon® MK from Rohm & Haas) and isothiazolinone derivatives such as alkylisothiazolinones and benzisothiazolinones (Acticide® MBS from Thor Chemie). Other plant growth regulators that can be incorporated seed coating compositions are described in US 2012/0108431, which is incorporated by reference in its entirety.

Nematicides.

Preferred nematode-antagonistic biocontrol agents include ARF18; *Arthrobotrys* spp.; *Chaetomium* spp.; *Cylindrocarpon* spp.; *Exophilia* spp.; *Fusarium* spp.; *Gliocladium* spp.; *Hirsutella* spp.; *Lecanicillium* spp.; *Monacrosporium* spp.; *Myrothecium* spp.; *Neocosmospora* spp.; *Paecilomyces* spp.; *Pochonia* spp.; *Stagonospora* spp.; vesicular-arbuscular mycorrhizal fungi, *Burkholderia* spp.; *Pasteuria* spp., *Brevibacillus* spp.; *Pseudomonas* spp.; and *Rhizobacteria*. Particularly preferred nematode-antagonistic biocontrol agents include ARF18, *Arthrobotrys oligospora*, *Arthrobotrys dactyloides*, *Chaetomium globosum*, *Cylindrocarpon heteronema*, *Exophilia jeanselmei*, *Exophilia pisciphila*, *Fusarium aspergilus*, *Fusarium solani*, *Gliocladium catenulatum*, *Gliocladium roseum*, *Gliocladium vixens*, *Hirsutella rhossiliensis*, *Hirsutella minnesotensis*, *Lecanicillium lecanii*, *Monacrosporium drechsleri*, *Monacrosporium gephyropagum*, *Myrotehcium verrucaria*, *Neocosmospora vasinfecta*, *Paecilomyces lilacinus*, *Pochonia chlamydosporia*, *Stagonospora heteroderae*, *Stagonospora phaseoli*, vesicular-arbuscular mycorrhizal fungi, *Burkholderia cepacia*, *Pasteuria penetrans*, *Pasteuria thornei*, *Pasteuria nishizawae*, *Pasteuria ramosa*, *Pastrueia usage*, *Brevibacillus laterosporus* strain G4, *Pseudomonas fluorescens* and *Rhizobacteria*.

Nutrients.

In another embodiment, the seed coating composition can comprise a nutrient. The nutrient can be selected from the group consisting of a nitrogen fertilizer including, but not limited to Urea, Ammonium nitrate, Ammonium sulfate, Non-pressure nitrogen solutions, Aqua ammonia, Anhydrous ammonia, Ammonium thiosulfate, Sulfur-coated urea, Urea-formaldehydes, IBDU, Polymer-coated urea, Calcium nitrate, Ureaform, and Methylene urea, phosphorous fertilizers such as Diammonium phosphate, Monoammonium phosphate, Ammonium polyphosphate, Concentrated superphosphate and Triple superphosphate, and potassium fertilizers such as Potassium chloride, Potassium sulfate, Potassium-magnesium sulfate, Potassium nitrate. Such compositions can exist as free salts or ions within the seed coat composition. Alternatively, nutrients/fertilizers can be complexed or chelated to provide sustained release over time.

Rodenticides.

Rodents such as mice and rats cause considerable economical damage by eating and soiling planted or stored seeds. Moreover, mice and rats transmit a large number of infectious diseases such as plague, typhoid, leptospirosis, trichinosis and salmonellosis. Anticoagulants such as coumarin and indandione derivatives play an important role in the control of rodents. These active ingredients are simple to handle, relatively harmless to humans and have the advantage that, as the result of the delayed onset of the activity, the animals being controlled identify no connection with the bait that they have ingested, therefore do not avoid it. This is an important aspect in particular in social animals such as rats, where individuals act as tasters. In one embodiment, the seed coating composition comprises a rodenticide selected from the group of substances consisting of 2-isovalerylindan-1,3-dione, 4-(quinoxalin-2-ylamino)benzenesulfonamide, alpha-chlorohydrin, aluminum phosphide, antu, arsenous oxide, barium carbonate, bisthiosemi, brodifacoum, bromadiolone, bromethalin, calcium cyanide, chloralose, chlorophacinone, cholecalciferol, coumachlor, coumafuryl, coumatetralyl, crimidine, difenacoum, difethialone, diphacinone, ergocalciferol, flocoumafen, fluoroacetamide, flupropadine, flupropadine hydrochloride, hydrogen cyanide, iodomethane, lindane, magnesium phosphide, methyl bromide, norbormide, phosacetim, phosphine, phosphorus, pindone, potassium arsenite, pyrinuron, scilliroside, sodium arsenite, sodium cyanide, sodium fluoroacetate, strychnine, thallium sulfate, warfarin and zinc phosphide.

Compatibility

In one embodiment, natural isolates of endophytes that are compatible with agrichemicals can be used to inoculate the plants according to the methods described herein. For example, endophytes that are compatible with agriculturally employed anticomplex agents can be isolated by plating a culture of endophytes on a petri dish comprising an effective concentration of the anticomplex agent, and isolating colonies of endophytes that are compatible with the anticomplex agent. In another embodiment, an endophyte that is compatible with an anticomplex agent is used for the methods described herein.

Bactericide-compatible endophyte can also be isolated by selection on liquid medium. The culture of endophytes can be plated on petri dishes without any forms of mutagenesis; alternatively, endophytes can be mutagenized using any means known in the art. For example, endophyte cultures can be exposed to UV light, gamma-irradiation, or chemical mutagens such as ethylmethanesulfonate (EMS) prior to selection on fungicide comprising media. Finally, where the mechanism of action of a particular bactericide is known, the target gene can be specifically mutated (either by gene deletion, gene replacement, site-directed mutagenesis, etc.) to generate an endophyte that is resilient against that particular chemical. It is noted that the above-described methods can be used to isolate endophytes that are compatible with both bacteriostatic and bactericidal compounds.

It will also be appreciated by one skilled in the art that a plant may be exposed to multiple types of anticomplex compounds, either simultaneously or in succession, for example at different stages of plant growth. Where the target plant is likely to be exposed to multiple anticomplex agents, an endophyte that is compatible with many or all of these agrichemicals can be used to inoculate the plant. An endophyte that is compatible with several agents can be isolated, for example, by serial selection. An endophyte that is compatible with the first agent can be isolated as described above (with or without prior mutagenesis). A culture of the resulting endophyte can then be selected for the ability to grow on liquid or solid media comprising the second agent (again, with or without prior mutagenesis). Colonies isolated from the second selection are then tested to confirm its compatibility to both agents.

Likewise, endophytes that are compatible to biocides (including herbicides such as glyphosate or anticomplex compounds, whether bacteriostatic or bactericidal) that are agriculturally employed can be isolated using methods similar to those described for isolating compatible endophytes. In one embodiment, mutagenesis of the endophyte population can be performed prior to selection with an anticomplex agent. In another embodiment, selection is performed on the endophyte population without prior mutagenesis. In still another embodiment, serial selection is performed on an endophyte: the endophyte is first selected for compatibility to a first anticomplex agent. The isolated compatible endophyte is then cultured and selected for compatibility to the second anticomplex agent. Any colony thus isolated is tested for compatibility to each, or both anticomplex agents to confirm compatibility with these two agents.

Compatibility with an antimicrobial agent can be determined by a number of means known in the art, including the comparison of the minimal inhibitory concentration (MIC) of the unmodified and modified endophytes. Therefore, in one embodiment, the present invention discloses an isolated modified endophyte, wherein the endophyte is modified such that it exhibits at least 3 fold greater, for example, at least 5 fold greater, at least 10 fold greater, at least 20 fold greater, at least 30 fold greater or more MIC to an antimicrobial agent when compared with the unmodified endophyte.

In one particular aspect, disclosed herein are endophytes with enhanced compatibility to the herbicide glyphosate. In one embodiment, the endophyte has a doubling time in growth medium comprising at least 1 mM glyphosate, for example, at least 2 mM glyphosate, at least 5 mM glyphosate, at least 10 mM glyphosate, at least 15 mM glyphosate or more, that is no more than 250%, for example, no more than 200%, no more than 175%, no more than 150%, or no more than 125%, of the doubling time of the endophyte in the same growth medium comprising no glyphosate. In one particular embodiment, the endophyte has a doubling time in growth medium comprising 5 mM glyphosate that is no more than 150% the doubling time of the endophyte in the same growth medium comprising no glyphosate.

In another embodiment, the endophyte has a doubling time in a plant tissue comprising at least 10 ppm glyphosate, for example, at least 15 ppm glyphosate, at least 20 ppm glyphosate, at least 30 ppm glyphosate, at least 40 ppm glyphosate or more, that is no more than 250%, for example, no more than 200%, no more than 175%, no more than 150%, or no more than 125%, of the doubling time of the endophyte in a reference plant tissue comprising no glyphosate. In one particular embodiment, the endophyte has a doubling time in a plant tissue comprising 40 ppm glyphosate that is no more than 150% the doubling time of the endophyte in a reference plant tissue comprising no glyphosate.

The selection process described above can be repeated to identify isolates of endophytes that are compatible with a multitude of agents.

Candidate isolates can be tested to ensure that the selection for agrichemical compatibility did not result in loss of a desired bioactivity. Isolates of endophytes that are compatible with commonly employed agents can be selected as described above. The resulting compatible endophyte can be compared with the parental endophyte on plants in its ability to promote germination.

The agrichemical compatible endophytes generated as described above can be detected in samples. For example, where a transgene was introduced to render the endophyte compatible with the agrichemical(s), the transgene can be used as a target gene for amplification and detection by PCR. In addition, where point mutations or deletions to a portion of a specific gene or a number of genes results in compatibility with the agrichemical(s), the unique point mutations can likewise be detected by PCR or other means known in the art. Such methods allow the detection of the endophyte even if it is no longer viable. Thus, commodity plant products produced using the agrichemical compatible endophytes described herein can readily be identified by employing these and related methods of nucleic acid detection.

Beneficial Attributes of Synthetic Combinations of Plant Elements and Endophytes Improved Attributes Conferred by Endophytes.

The present invention contemplates the establishment of a symbiont in a plant element. In one embodiment, endophyte association results in a detectable change to the plant element, in particular the seed or the whole plant. The detectable change can be an improvement in a number of agronomic traits (e.g., improved general health, increased response to biotic or abiotic stresses, or enhanced properties of the plant or a plant element, including fruits and grains). Alternatively, the detectable change can be a physiological or biological change that can be measured by methods known in the art. The detectable changes are described in more detail in the sections below. As used herein, an endophyte is considered to have conferred an improved agricultural trait whether or not the improved trait arose from the plant, the endophyte, or the concerted action between the plant and endophyte. Therefore, for example, whether a beneficial hormone or chemical is produced by the plant or the endophyte, for purposes of the present invention, the endophyte will be considered to have conferred an improved agronomic trait upon the host plant.

In some aspects, provided herein, are methods for producing a seed of a plant with a heritably altered trait. The trait of the plant can be altered without known genetic modification of the plant genome, and comprises the following steps. First, a preparation of an isolated endophyte that is heterologous to the seed of the plant is provided, and optionally processed to produce an endophyte formulation. The endophyte formulation is then contacted with the plant. The plants are then allowed to go to seed, and the seeds are collected.

Improved General Health.

Also described herein are plants, and fields of plants, that are associated with beneficial endophytes, such that the overall fitness, productivity or health of the plant or a portion thereof, is maintained, increased and/or improved over a period of time. Improvement in overall plant health can be assessed using numerous physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof. Improved plant health, or improved field health, can also be demonstrated through improved resistance or response to a given stress, either biotic or abiotic stress, or a combination of one or more abiotic stresses, as provided herein.

Other Abiotic Stresses.

Disclosed herein are endophyte-associated plants with increased resistance to an abiotic stress. Exemplary abiotic stresses include, but are not limited to:

Drought and Heat Tolerance.

In some cases, a plant resulting from seeds or other plant components treated with an endophyte can exhibit a physiological change, such as a compensation of the stress-induced reduction in photosynthetic activity (expressed, for example, as $\Delta Fv/Fm$) after exposure to heat shock or drought conditions as compared to a corresponding control, genetically identical plant that does not contain the endophytes grown in the same conditions. In some cases, the endophyte-associated plant as disclosed herein can exhibit an increased change in photosynthetic activity ΔFv(ΔFv/Fm) after heat-shock or drought stress treatment, for example 1, 2, 3, 4, 5, 6, 7 days or more after the heat-shock or drought stress treatment, or until photosynthesis ceases, as compared with corresponding control plant of similar developmental stage but not comprising endophytes. For example, a plant having an endophyte able to confer heat and/or drought-tolerance can exhibit a ΔFv/Fm of from about 0.1 to about 0.8 after exposure to heat-shock or drought stress or a ΔFv/Fm range of from about 0.03 to about 0.8 under one day, or 1, 2, 3, 4, 5, 6, 7, or over 7 days post heat-shock or drought stress treatment, or until photosynthesis ceases. In some embodiments, stress-induced reductions in photosynthetic activity can be compensated by at least about 0.25% (for example, at least about 0.5%, at least about 1%, at least about 2%, at least about 3, at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, at least about 95%, at least about 99% or at least 100%) as compared to the photosynthetic activity decrease in a corresponding reference agricultural plant following heat shock conditions. Significance of the difference between endophyte-associated and reference agricultural plants can be established upon demonstrating statistical significance, for example at $p<0.05$ with an appropriate parametric or non-parametric statistic, e.g., Chi-square test, Student's t-test, Mann-Whitney test, or F-test based on the assumption or known facts that the endophyte-associated plant and reference agricultural plant have identical or near identical genomes (isoline comparison).

In some embodiments, the plants comprise endophytes able to increase heat and/or drought-tolerance in sufficient quantity, such that increased growth or improved recovery from wilting under conditions of heat or drought stress is observed. For example, an endophyte population described herein can be present in sufficient quantity in a plant, resulting in increased growth as compared to a plant that does not contain endophytes, when grown under drought conditions or heat shock conditions, or following such conditions. Increased heat and/or drought tolerance can be assessed with physiological parameters including, but not limited to, increased height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, wilt recovery, turgor pressure, or any combination thereof, as compared to a reference agricultural plant grown under similar conditions.

In various embodiments, endophytes introduced into altered seed microbiota can confer in the resulting plant thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased protein content, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. A difference between the endophyte-associated plant and a reference agricultural plant can also be measured using other methods known in the art (see, for example, Haake et al. (2002) Plant Physiol. 130: 639-648, incorporated herein by reference in its entirety)

Salt Stress.

In other embodiments, endophytes able to confer increased tolerance to salinity stress can be introduced into plants. The resulting plants comprising endophytes can exhibit increased resistance to salt stress, whether measured in terms of survival under saline conditions, or overall growth during, or following salt stress. The physiological parameters of plant health recited above, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., isogenic plants without the endophytes) grown under identical conditions.

In other instances, endophyte-associated plants and reference agricultural plants can be grown in soil or growth media comprising different concentration of sodium to establish the inhibitory concentration of sodium (expressed, for example, as the concentration in which growth of the plant is inhibited by 50% when compared with plants grown under no sodium stress). Therefore, in another embodiment, a plant resulting from seeds comprising an endophyte able to confer salt tolerance described herein exhibits an increase in the inhibitory sodium concentration by at least 10 mM, for example at least 15 mM, at least 20 mM, at least 30 mM, at least 40 mM, at least 50 mM, at least 60 mM, at least 70 mM, at least 80 mM, at least 90 mM, at least 100 mM or more, when compared with the reference agricultural plants.

High Metal Content.

Plants are sessile organisms and therefore must contend with the environment in which they are placed. Plants have adapted many mechanisms to deal with chemicals and substances that may be deleterious to their health. Heavy metals in particular represent a class of toxins that are highly relevant for plant growth and agriculture, because many of them are associated with fertilizers and sewage sludge used to amend soils and can accumulate to toxic levels in agricultural fields (Mortvedt 1996, Fertilizer Res. 43:55-61; Kidd et al. 2007, Chemosphere 66:1458-1467, incorporated herein by reference in their entirety). Therefore, for agricultural purposes, it is important to have plants that are able to tolerate soils comprising elevated levels of toxic heavy metals. Plants cope with toxic levels of heavy metals (for example, nickel, cadmium, lead, mercury, arsenic, or aluminum) in the soil by excretion and internal sequestration (Choi et al. 2001, Planta 213:45-50; Kumar et al. 1995, Environ. Sci. Technol. 29:1232-1238, incorporated herein by reference in its entirety)). Endophytes that are able to confer increased heavy metal tolerance may do so by enhancing sequestration of the metal in certain compartments away from the seed or fruit and/or by supplementing other nutrients necessary to remediate the stress (Burd et al. 2000, Can. J. Microbiol. 46:237-245; Rajkumar et al. 2009, Chemosphere 77:153-160, incorporated herein by reference in their entirety). Use of such endophytes in a plant would allow the development of novel plant-endophyte combinations for purposes of environmental remediation (also known as phytoremediation). Therefore, in one embodiment, the plant comprising endophytes shows increased metal tolerance as compared to a reference agricultural plant grown under the same heavy metal concentration in the soil.

Alternatively, the inhibitory concentration of the heavy metal can be determined for endophyte-associated plant and compared with a reference agricultural plant under the same conditions. Therefore, in one embodiment, the plants resulting from seeds comprising an endophyte able to confer heavy metal tolerance described herein exhibit an increase in the inhibitory sodium concentration by at least 0.1 mM, for example at least 0.3 mM, at least 0.5 mM, at least 1 mM, at least 2 mM, at least 5 mM, at least 10 mM, at least 15 mM, at least 20 mM, at least 30 mM, at least 50 mM or more, when compared with the reference agricultural plants.

Finally, plants inoculated with endophytes that are able to confer increased metal tolerance exhibit an increase in overall metal excretion by at least 10%, for example at least 15%, at least 20%, at least 30%, at least 40%, at least 50%, at least 60%, at least 75%, at least 100%, at least 150%, at least 200%, at least 300% or more, when compared with uninoculated plants grown under the same conditions.

Low Nutrient Stress.

Endophytes described herein may also confer to the plant an increased ability to grow in nutrient limiting conditions, for example by solubilizing or otherwise making available to the plants macronutrients or micronutrients that are complexed, insoluble, or otherwise in an unavailable form. In one embodiment, a plant is inoculated with an endophyte that confers increased ability to liberate and/or otherwise provide to the plant with nutrients selected from the group consisting of phosphate, nitrogen, potassium, iron, manganese, calcium, molybdenum, vitamins, or other micronutrients. Such a plant can exhibit increased growth in soil comprising limiting amounts of such nutrients when compared with reference agricultural plant. Differences between the endophyte-associated plant and reference agricultural plant can be measured by comparing the biomass of the two plant types grown under limiting conditions, or by measuring the physical parameters described above. Therefore, in one embodiment, the plant comprising endophyte shows increased tolerance to nutrient limiting conditions as compared to a reference agricultural plant grown under the same nutrient limited concentration in the soil, as measured for example by increased biomass or seed yield of at least 10%, for example at least 15%, at least 20%, at least 30%, at least 40%, at least 50%, at least 60%, at least 75%, at least 100%, at least 150%, at least 200%, at least 300% or more, when compared with uninoculated plants grown under the same conditions. In another embodiment, the plant containing the endophyte is able to grown under nutrient stress conditions while exhibiting no difference in the physiological parameter compared to a plant that is grown without nutrient stress. In some embodiments, such a plant will exhibit no difference in the physiological parameter when grown with 2-5% less nitrogen than average cultivation practices on normal agricultural land, for example, at least 5-10% less nitrogen, at least 10-15% less nitrogen, at least 15-20% less nitrogen, at least 20-25% less nitrogen, at least 25-30% less nitrogen, at least 30-35% less nitrogen, at least 35-40% less nitrogen, at least 40-45% less nitrogen, at least 45-50% less nitrogen, at least 50-55% less nitrogen, at least 55-60% less nitrogen, at least 60-65% less nitrogen, at least 65-70% less nitrogen, at least 70-75% less nitrogen, at least 80-85% less nitrogen, at least 85-90% less nitrogen, at least 90-95% less nitrogen, or less, when compared with crop plants grown under normal conditions during an average growing season. In some embodiments, the microbe capable of providing nitrogen-stress tolerance to a plant is diazotrophic. In other embodiments, the microbe capable of providing nitrogen-stress tolerance to a plant is non-diazotrophic.

Cold Stress.

In some cases, endophytes can confer to the plant the ability to tolerate cold stress. Many known methods exist for the measurement of a plant's tolerance to cold stress (as reviewed, for example, in Thomashow (2001) Plant Physiol. 125: 89-93, and Gilmour et al. (2000) Plant Physiol. 124: 1854-1865, both of which are incorporated herein by reference in their entirety). As used herein, cold stress refers to both the stress induced by chilling (0° C.-15° C.) and freezing (<0° C.). Some cultivars of agricultural plants can be particularly sensitive to cold stress, but cold tolerance traits may be multigenic, making the breeding process difficult. Endophytes able to confer cold tolerance would potentially reduce the damage suffered by farmers on an annual basis Barka et al. 2006, Appl. Environ. Microbiol. 72:7246-7252, incorporated herein by reference in its entirety). Improved response to cold stress can be measured by survival of plants, production of protectant substances such as anthocyanin, the amount of necrosis of parts of the plant, or a change in crop yield loss, as well as the physiological parameters used in other examples. Therefore, in one embodiment, the plant comprising endophytes shows increased cold tolerance exhibits as compared to a reference agricultural plant grown under the same conditions of cold stress.

Biotic Stress.

In other embodiments, the endophyte protects the plant from a biotic stress, for example, insect infestation, nematode infestation, complex infection, fungal infection, oomycete infection, protozoal infection, viral infection, and herbivore grazing, or a combination thereof.

Insect Herbivory.

There are an abundance of insect pest species that can infect or infest a wide variety of plants. Pest infestation can lead to significant damage. Insect pests that infest plant species are particularly problematic in agriculture as they can cause serious damage to crops and significantly reduce plant yields. A wide variety of different types of plant are susceptible to pest infestation including commercial crops such as cotton, soybean, wheat, barley, and corn.

In some cases, endophytes described herein may confer upon the host plant the ability to repel insect herbivores. In other cases, endophytes may produce, or induce the production in the plant of, compounds which are insecticidal or insect repellant. The insect may be any one of the common pathogenic insects affecting plants, particularly agricultural plants.

The endophyte-associated plant can be tested for its ability to resist, or otherwise repel, pathogenic insects by measuring, for example, insect load, overall plant biomass, biomass of the fruit or grain, percentage of intact leaves, or other physiological parameters described herein, and comparing with a reference agricultural plant. In one embodiment, the endophyte-associated plant exhibits increased biomass as compared to a reference agricultural plant grown under the same conditions (e.g., grown side-by-side, or adjacent to, endophyte-associated plants). In other embodiments, the endophyte-associated plant exhibits increased fruit or grain yield as compared to a reference agricultural plant grown under the same conditions (e.g., grown side-by-side, or adjacent to, endophyte-associated plants).

Nematodes.

Nematodes are microscopic roundworms that feed on the roots, fluids, leaves and stems of more than 2,000 row crops, vegetables, fruits, and ornamental plants, causing an estimated $100 billion crop loss worldwide and accounting for 13% of global crop losses due to disease. A variety of parasitic nematode species infect crop plants, including root-knot nematodes (RKN), cyst- and lesion-forming nematodes. Root-knot nematodes, which are characterized by causing root gall formation at feeding sites, have a relatively broad host range and are therefore parasitic on a large number of crop species. The cyst- and lesion-forming nematode species have a more limited host range, but still cause considerable losses in susceptible crops.

Signs of nematode damage include stunting and yellowing of leaves, and wilting of the plants during hot periods. Nematode infestation, however, can cause significant yield losses without any obvious above-ground disease symptoms. The primary causes of yield reduction are due to underground root damage. Roots infected by SCN are dwarfed or stunted. Nematode infestation also can decrease the number of nitrogen-fixing nodules on the roots, and may make the roots more susceptible to attacks by other soil-borne plant nematodes.

In one embodiment, the endophyte-associated plant has an increased resistance to a nematode when compared with a reference agricultural plant. As before with insect herbivores, biomass of the plant or a portion of the plant, or any of the other physiological parameters mentioned elsewhere, can be compared with the reference agricultural plant grown under the same conditions. Particularly useful measurements include overall plant biomass, biomass and/or size of the fruit or grain, and root biomass. In one embodiment, the endophyte-associated plant exhibits increased biomass as compared to a reference agricultural plant grown under the same conditions (e.g., grown side-by-side, or adjacent to, the endophyte-associated plants, under conditions of nematode challenge). In another embodiment, the endophyte-associated plant exhibits increased root biomass as compared to a reference agricultural plant grown under the same conditions (e.g., grown side-by-side, or adjacent to, the endophyte-associated plants, under conditions of nematode challenge). In still another embodiment, the endophyte-associated plant exhibits increased fruit or grain yield as compared to a reference agricultural plant grown under the same conditions (e.g., grown side-by-side, or adjacent to, the endophyte-associated plants, under conditions of nematode challenge).

Fungal Pathogens.

Fungal diseases are responsible for yearly losses of over $10 Billion on agricultural crops in the US, represent 42% of global crop losses due to disease, and are caused by a large variety of biologically diverse pathogens. Different strategies have traditionally been used to control them. Resistance traits have been bred into agriculturally important varieties, thus providing various levels of resistance against either a narrow range of pathogen isolates or races, or against a broader range. However, this involves the long and labor intensive process of introducing desirable traits into commercial lines by genetic crosses and, due to the risk of pests evolving to overcome natural plant resistance, a constant effort to breed new resistance traits into commercial lines is required. Alternatively, fungal diseases have been controlled by the application of chemical fungicides. This strategy usually results in efficient control, but is also associated with the possible development of resistant pathogens and can be associated with a negative impact on the environment. Moreover, in certain crops, such as barley and wheat, the control of fungal pathogens by chemical fungicides is difficult or impractical.

The present invention contemplates the use of endophytes that are able to confer resistance to fungal pathogens to the host plant. Increased resistance to fungal inoculation can be measured, for example, using any of the physiological parameters presented above, by comparing with reference agricultural plants. In one embodiment, the endophyte-associated plant exhibits increased biomass and/or less pronounced disease symptoms as compared to a reference agricultural plant grown under the same conditions (e.g., grown side-by-side, or adjacent to, the endophyte-associated plants, infected with the fungal pathogen). In still another embodiment, the endophyte-associated plant exhibits increased fruit or grain yield as compared to a reference agricultural plant grown under the same conditions (e.g., grown side-by-side, or adjacent to, the endophyte-associated plants, infected with the fungal pathogen). In another embodiment, the endophyte-associated plant exhibits decreased hyphal growth as compared to a reference agricultural plant grown under the same conditions (e.g., grown side-by-side, or adjacent to, the endophyte-associated plants, infected with the fungal pathogen).

Viral Pathogens.

Plant viruses are estimated to account for 18% of global crop losses due to disease. There are numerous examples of viral pathogens affecting agricultural productivity. In one embodiment, the endophyte provides protection against viral pathogens such that the plant has increased biomass as compared to a reference agricultural plant grown under the same conditions. In still another embodiment, the endophyte-associated plant exhibits greater fruit or grain yield, when challenged with a virus, as compared to a reference agricultural plant grown under the same conditions. In yet another embodiment, the endophyte-associated plant exhibits lower viral titer, when challenged with a virus, as compared to a reference agricultural plant grown under the same conditions.

Complex Pathogens.

Likewise, endofungal bacterial pathogens are a significant problem negatively affecting agricultural productivity and accounting for 27% of global crop losses due to plant disease. In one embodiment, the endophyte described herein provides protection against endofungal bacterial pathogens such that the plant has greater biomass as compared to a reference agricultural plant grown under the same conditions. In still another embodiment, the endophyte-associated plant exhibits greater fruit or grain yield, when challenged with a complex pathogen, as compared to a reference agricultural plant grown under the same conditions. In yet another embodiment, the endophyte-associated plant exhibits lower complex count, when challenged with a bacterium, as compared to a reference agricultural plant grown under the same conditions.

Improvement of Other Traits.

In other embodiments, the endophyte can confer other beneficial traits to the plant. Improved traits can include an improved nutritional content of the plant or plant element used for human consumption. In one embodiment, the endophyte-associated plant is able to produce a detectable change in the content of at least one nutrient. Examples of such nutrients include amino acid, protein, oil (including any one of Oleic acid, Linoleic acid, Alpha-linoleic acid, Saturated fatty acids, Palmitic acid, Stearic acid and Trans fats), carbohydrate (including sugars such as sucrose, glucose and fructose, starch, or dietary fiber), Vitamin A, Thiamine (vit. B1), Riboflavin (vit. B2), Niacin (vit. B3), Pantothenic acid (B5), Vitamin B6, Folate (vit. B9), Choline, Vitamin C, Vitamin E, Vitamin K, Calcium, Iron, Magnesium, Manganese, Phosphorus, Potassium, Sodium, Zinc. In one embodiment, the endophyte-associated plant or part thereof contains at least one increased nutrient when compared with reference agricultural plants.

In other cases, the improved trait can include reduced content of a harmful or undesirable substance when compared with reference agricultural plants. Such compounds include those which are harmful when ingested in large quantities or are bitter tasting (for example, oxalic acid, amygdalin, certain alkaloids such as solanine, caffeine, nicotine, quinine and morphine, tannins, cyanide). As such, in one embodiment, the endophyte-associated plant or part thereof contains less of the undesirable substance when compared with reference agricultural plant. In a related embodiment, the improved trait can include improved taste of the plant or a part of the plant, including the fruit or seed. In a related embodiment, the improved trait can include reduction of undesirable compounds produced by other endophytes in plants, such as degradation of *Fusarium*-produced deoxynivalenol (also known as vomitoxin and a virulence factor involved in *Fusarium* head blight of maize and wheat) in a part of the plant, including the fruit or seed.

In other cases, the improved trait can be an increase in overall biomass of the plant or a part of the plant, including its fruit or seed.

The endophyte-associated plant can also have an altered hormone status or altered levels of hormone production when compared with a reference agricultural plant. An alteration in hormonal status may affect many physiological parameters, including flowering time, water efficiency, apical dominance and/or lateral shoot branching, increase in root hair, and alteration in fruit ripening.

The association between the endophyte and the plant can also be detected using other methods known in the art. For example, the biochemical, metabolomics, proteomic, genomic, epigenomic and/or transcriptomic profiles of endophyte-associated plants can be compared with reference agricultural plants under the same conditions.

Metabolomic differences between the plants can be detected using methods known in the art. For example, a biological sample (whole tissue, exudate, phloem sap, xylem sap, root exudate, etc.) from endophyte-associated and reference agricultural plants can be analyzed essentially as described in Fiehn et al., (2000) Nature Biotechnol., 18, 1157-1161, or Roessner et al., (2001) Plant Cell, 13, 11-29, incorporated herein by reference in its entirety. Such metabolomic methods can be used to detect differences in levels in hormone, nutrients, secondary metabolites, root exudates, phloem sap content, xylem sap content, heavy metal content, and the like. Such methods are also useful for detecting alterations in endophyte content and status; for example, the presence and levels of signaling molecules (e.g., autoinducers and pheromones), which can indicate the status of group-based behavior of endophytes based on, for example, population density (see, for example Daniels et al., 2006, PNAS 103: 14965-14970; Eberhard et al. 1981, Biochemistry 20: 2444-2449, incorporated herein by reference in its entirety). Transcriptome analysis (reviewed, for example, in Usadel & Fernie, 2013, Front. Plant Sci. 4:48, incorporated herein by reference in its entirety) of endophyte-associated and reference agricultural plants can also be performed to detect changes in expression of at least one transcript, or a set or network of genes upon endophyte association. Similarly, epigenetic changes can be detected using methylated DNA immunoprecipitation followed by high-throughput sequencing (Vining et al. 2013, BMC Plant Biol. 13:92, incorporated herein by reference in its entirety).

Populations of Plant Elements

In another aspect, the invention provides for a substantially uniform population of plant elements comprising a plurality of plant elements comprising the endophytic microbial population, as described herein above. Substantial uniformity can be determined in many ways. In some cases, at least 10%, for example, at least 20%, at least 30%, at least 40%, at least 50%, at least 60%, at least 70%, at least 75%, at least 80%, at least 90%, at least 95% or more of the plant elements in the population, contains the endophytic microbial population in an amount effective to colonize the plant disposed on the surface of the plant elements. In other cases, at least 10%, for example, at least 20%, at least 30%, at least 40%, at least 50%, at least 60%, at least 70%, at least 75%, at least 80%, at least 90%, at least 95% or more of the plant elements in the population, contains at least 100 CFU or spores on its surface, for example, at least 200 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, or at least 1,000,000 CFU or spores per plant element or more.

The synthetic combinations of the present invention may be confined within an object selected from the group consisting of: bottle, jar, ampule, package, vessel, bag, box, bin, envelope, carton, container, silo, shipping container, truck bed, and case. In a particular embodiment, the population of plant elements is packaged in a bag or container suitable for commercial sale. For example, a bag contains a unit weight or count of the plant elements comprising the endophytic microbial population as described herein, and further comprises a label. In one embodiment, the bag or container contains at least 1,000 plant elements, for example, at least 5,000 plant elements, at least 10,000 plant elements, at least 20,000 plant elements, at least 30,000 plant elements, at least 50,000 plant elements, at least 70,000 plant elements, at least 80,000 plant elements, at least 90,000 plant elements or more. In another embodiment, the bag or container can comprise a discrete weight of plant elements, for example, at least 1 lb, at least 2 lbs, at least 5 lbs, at least 10 lbs, at least 30 lbs, at least 50 lbs, at least 70 lbs or more. The bag or container comprises a label describing the plant elements and/or said endophytic microbial population. The label can contain additional information, for example, the information selected from the group consisting of: net weight, lot number, geographic origin of the plant elements, test date, germination rate, inert matter content, and the amount of noxious weeds, if any. Suitable containers or packages include those traditionally used in plant element commercialization. The invention also contemplates other containers with more sophisticated storage capabilities (e.g., with microbiologically tight wrappings or with gas- or water-proof containments).

In some cases, a sub-population of plant elements comprising the endophytic microbial population is further selected on the basis of increased uniformity, for example, on the basis of uniformity of microbial population. For example, individual plant elements of pools collected from individual cobs, individual plants, individual plots (representing plants inoculated on the same day) or individual fields can be tested for uniformity of microbial density, and only those pools meeting specifications (e.g., at least 80% of tested plant elements have minimum density, as determined by quantitative methods described elsewhere) are combined to provide the agricultural plant element sub-population.

The methods described herein can also comprise a validating step. The validating step can entail, for example, growing some plant elements collected from the inoculated plants into mature agricultural plants, and testing those individual plants for uniformity. Such validating step can be performed on individual plant elements collected from cobs, individual plants, individual plots (representing plants inoculated on the same day) or individual fields, and tested as described above to identify pools meeting the required specifications.

Populations of Plants, Agricultural Fields

A major focus of crop improvement efforts has been to select varieties with traits that give, in addition to the highest return, the greatest homogeneity and uniformity. While inbreeding can yield plants with substantial genetic identity, heterogeneity with respect to plant height, flowering time, and time to seed, remain impediments to obtaining a homogeneous field of plants. The inevitable plant-to-plant variability are caused by a multitude of factors, including uneven environmental conditions and management practices. Another possible source of variability can, in some cases, be due to the heterogeneity of the microbial population inhabit the plants. By providing endophytic microbial populations onto seeds and seedlings, the resulting plants generated by germinating the seeds and seedlings have a more consistent microbial composition, and thus are expected to yield a more uniform population of plants.

Therefore, in another aspect, the invention provides a substantially uniform population of plants. The population comprises at least 100 plants, for example, at least 300 plants, at least 1,000 plants, at least 3,000 plants, at least 10,000 plants, at least 30,000 plants, at least 100,000 plants or more. The plants are grown from the seeds comprising the endophytic microbial population as described herein. The increased uniformity of the plants can be measured in a number of different ways.

In one embodiment, there is an increased uniformity with respect to the microbes within the plant population. For example, in one embodiment, a substantial portion of the population of plants, for example at least 10%, at least 20%, at least 30%, at least 40%, at least 50%, at least 60%, at least 70%, at least 75%, at least 80%, at least 90%, at least 95% or more of the seeds or plants in a population, contains a threshold number of the endophytic microbial population. The threshold number can be at least 100 CFU or spores, for example at least 300 CFU or spores, at least 1,000 CFU or spores, at least 3,000 CFU or spores, at least 10,000 CFU or spores, at least 30,000 CFU or spores, at least 100,000 CFU or spores or more, in the plant or a part of the plant. Alternatively, in a substantial portion of the population of plants, for example, in at least 1%, at least 10%, at least 20%, at least 30%, at least 40%, at least 50%, at least 60%, at least 70%, at least 75%, at least 80%, at least 90%, at least 95% or more of the plants in the population, the endophytic microbial population that is provided to the seed or seedling represents at least 10%, least 20%, at least 30%, at least 40%, at least 50%, at least 60%, at least 70%, at least 80%, at least 90%, at least 95%, at least 99%, or 100% of the total microbe population in the plant/seed.

In another embodiment, there is an increased uniformity with respect to a physiological parameter of the plants within the population. In some cases, there can be an increased uniformity in the height of the plants when compared with a population of reference agricultural plants grown under the same conditions. For example, there can be a reduction in the standard deviation in the height of the plants in the population of at least 2%, for example at least 3%, at least 4%, at least 5%, at least 6%, at least 7%, at least 8%, at least 9%, at least 10%, at least 15%, at least 20%, at least 30%, at least 40%, at least 50%, at least 60% or more, when compared with a population of reference agricultural plants grown under the same conditions. In other cases, there can be a reduction in the standard deviation in the flowering time of the plants in the population of at least 2%, for example at least 3%, at least 4%, at least 5%, at least 6%, at least 7%, at least 8%, at least 9%, at least 10%, at least 15%, at least 20%, at least 30%, at least 40%, at least 50%, at least 60% or more, when compared with a population of reference agricultural plants grown under the same conditions.

Commodity Plant Product

The present invention provides a commodity plant product, as well as methods for producing a commodity plant product, that is derived from a plant of the present invention. As used herein, a "commodity plant product" refers to any composition or product that is comprised of material derived from a plant, seed, plant cell, or plant part of the present invention. Commodity plant products may be sold to consumers and can be viable or nonviable. Nonviable commodity products include but are not limited to nonviable seeds and grains; processed seeds, seed parts, and plant parts; dehydrated plant tissue, frozen plant tissue, and processed plant tissue; seeds and plant parts processed for animal feed for terrestrial and/or aquatic animal consumption, oil, meal, flour, flakes, bran, fiber, paper, tea, coffee, silage, crushed of whole grain, and any other food for human or animal consumption; and biomasses and fuel products; and raw material in industry. Industrial uses of oils derived from the agricultural plants described herein include ingredients for paints, plastics, fibers, detergents, cosmetics, lubricants, and biodiesel fuel. Soybean oil may be split, inter-esterified, sulfurized, epoxidized, polymerized, ethoxylated, or cleaved. Designing and producing soybean oil derivatives with improved functionality and improved oliochemistry is a rapidly growing field. The typical mixture of triglycerides is usually split and separated into pure fatty acids, which are then combined with petroleum-derived alcohols or acids, nitrogen, sulfonates, chlorine, or with fatty alcohols derived from fats and oils to produce the desired type of oil or fat. Commodity plant products also include industrial compounds, such as a wide variety of resins used in the formulation of adhesives, films, plastics, paints, coatings and foams.

In some cases, commodity plant products derived from the plants, or using the methods of the present invention can be identified readily. In some cases, for example, the presence of viable endophytic microbes can be detected using the methods described herein elsewhere. In other cases, particularly where there are no viable endophytic microbes, the commodity plant product may still contain at least a detectable amount of the specific and unique DNA corresponding to the microbes described herein. Any standard method of detection for polynucleotide molecules may be used, including methods of detection disclosed herein.

Throughout the specification, the word "comprise," or variations such as "comprises" or "comprising," will be understood to imply the inclusion of a stated integer or group of integers but not the exclusion of any other integer or group of integers.

Methods of Using Endophytes and Synthetic Compositions Comprising Endophytes

As described herein, purified endophyte populations and compositions comprising the same (e.g., formulations) can be used to confer beneficial traits to the host plant including, for example, one or more of the following: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome relative to a reference plant. For example, in some embodiments, a purified endophyte population can improve two or more such beneficial traits, e.g., water use efficiency and increased tolerance to drought. Such traits can be heritable by progeny of the agricultural plant to which endophyte was applied or by progeny of the agricultural plant that was grown from the seed associated with endophyte.

In one aspect of the invention, the endophytes impart to the host plant an improved ability to cope with water-limited conditions.

In some cases, the endophyte may produce one or more compounds and/or have one or more activities, e.g., one or more of the following: production of a metabolite, production of a phytohormone such as auxin, production of acetoin, production of an antimicrobial compound, production of a siderophore, production of a cellulase, production of a pectinase, production of a chitinase, production of a xylanase, nitrogen fixation, or mineral phosphate solubilization. For example, an endophyte can produce a phytohormone selected from the group consisting of an auxin, a cytokinin, a gibberellin, ethylene, a brassinosteroid, and abscisic acid. In one particular embodiment, the endophyte produces auxin (e.g., indole-3-acetic acid (IAA)). Production of auxin can be assayed as described herein. Many of the microbes described herein are capable of producing the plant hormone auxin indole-3-acetic acid (IAA) when grown in culture. Auxin plays a key role in altering the physiology of the plant, including the extent of root growth. Therefore, in another embodiment, the endofungal endophytic population is disposed on the surface or within a tissue of the seed or seedling in an amount effective to detectably increase production of auxin in the agricultural plant when compared with a reference agricultural plant. In one embodiment, the increased auxin production can be detected in a tissue type selected from the group consisting of the root, shoot, leaves, and flowers.

In some embodiments, the endophyte can produce a compound with antimicrobial properties. For example, the compound can have antibacterial properties, as determined by the growth assays provided herein. In one embodiment, the compound with antibacterial properties shows bacteriostatic or bactericidal activity against *E. coli* and/or *Bacillus* sp. In another embodiment, the endophyte produces a compound with antifungal properties, for example, fungicidal or fungistatic activity against *S. cerevisiae* and/or *Rhizoctonia*.

In some embodiments, the endophyte is a fungus capable of nitrogen fixation, and is thus capable of producing ammonium from atmospheric nitrogen. The ability of a fungus to fix nitrogen can be confirmed by testing for growth of the fungus in nitrogen-free growth media, for example, LGI media, as described herein.

In some embodiments, the endophyte can produce a compound that increases the solubility of mineral phosphate in the medium, i.e., mineral phosphate solubilization, for example, using the growth assays described herein. In one embodiment, the endophyte produces a compound that allows the bacterium to grow in growth media comprising $Ca_3HPO_4$ as the sole phosphate source.

In some embodiments, the endophyte can produce a siderophore. Siderophores are small high-affinity iron chelating agents secreted by microorganisms that increase the bioavailability of iron. Siderophore production by the endophyte can be detected, for example, using the methods described herein, as well as elsewhere (Perez-Miranda et al., 2007, J Microbiol Methods. 70:127-31, incorporated herein by reference in its entirety).

In some embodiments, the endophyte can produce a hydrolytic enzyme. For example, in one embodiment, an endophyte can produce a hydrolytic enzyme selected from the group consisting of a cellulase, a pectinase, a chitinase and a xylanase. Hydrolytic enzymes can be detected using the methods described herein (see also, cellulase: Quadt-Hallmann et al., (1997) Can. J. Microbiol., 43: 577-582; pectinase: Soares et al. (1999). Revista de Microbiolgia 30(4): 299-303; chitinase: Li et al., (2004) Mycologia 96: 526-536; and xylanase: Suto et al., (2002) J Biosci Bioeng. 93:88-90, each of which is incorporated by reference in its entirety).

In some embodiment, synthetic combinations comprise synergistic endofungal endophytic populations. As used herein, the term "synergistic endophytic populations" refers to two or more endophyte populations that produce one or more effects (e.g., two or more or three or more effects) that are greater than the sum of their individual effects. For example, in some embodiments, a purified endophyte population contains two or more different endophytes that are capable of synergistically increasing at least one of e.g., production of a phytohormone such as auxin, production of acetoin, production of an antimicrobial compound, production of a siderophore, production of a cellulase, production of a pectinase, production of a chitinase, production of a xylanase, nitrogen fixation, or mineral phosphate solubilization in an agricultural plant. Synergistically increasing one or more of such properties can increase a beneficial trait in an agricultural plant, such as an increase in drought tolerance.

In some embodiments, a purified endofungal population comprising one or more endophytes can increase one or more properties such as production of a phytohormone such as auxin, production of acetoin, production of an antimicrobial compound, production of a siderophore, production of a cellulase, production of a pectinase, production of a chitinase, production of a xylanase, or mineral phosphate solubilization in an agricultural plant, without increasing nitrogen fixation in the agricultural plant.

In some embodiments, metabolites in plants can be modulated by making synthetic combinations of purified endophytic populations. For example, an endophyte described herein can cause a detectable modulation (e.g., an increase or decrease) in the level of various metabolites, e.g., indole-3-carboxylic acid, trans-zeatin, abscisic acid, phaseic acid, indole-3-acetic acid, indole-3-butyric acid, indole-3-acrylic acid, jasmonic acid, jasmonic acid methyl ester, dihydrophaseic acid, gibberellin A3, salicylic acid, upon colonization of a plant.

In some embodiments, the endophyte modulates the level of the metabolite directly (e.g., the microbe itself produces the metabolite, resulting in an overall increase in the level of the metabolite found in the plant). In other cases, the agricultural plant, as a result of the association with the endophytic microbe (e.g., an endophyte), exhibits a modulated level of the metabolite (e.g., the plant reduces the expression of a biosynthetic enzyme responsible for production of the metabolite as a result of the microbe inoculation). In still other cases, the modulation in the level of the metabolite is a consequence of the activity of both the microbe and the plant (e.g., the plant produces increased amounts of the metabolite when compared with a reference agricultural plant, and the endophytic microbe also produces the metabolite). Therefore, as used herein, a modulation in the level of a metabolite can be an alteration in the metabolite level through the actions of the microbe and/or the inoculated plant.

The levels of a metabolite can be measured in an agricultural plant, and compared with the levels of the metabolite in a reference agricultural plant, and grown under the same conditions as the inoculated plant. The uninoculated plant that is used as a reference agricultural plant is a plant that has not been applied with a formulation with the endophytic microbe (e.g., a formulation comprising a population of purified endophytes). The uninoculated plant used as the reference agricultural plant is generally the same species and cultivar as, and is isogenic to, the inoculated plant.

The metabolite whose levels are modulated (e.g., increased or decreased) in the endophyte-associated plant may serve as a primary nutrient (i.e., it provides nutrition for the humans and/or animals who consume the plant, plant tissue, or the commodity plant product derived therefrom, including, but not limited to, a sugar, a starch, a carbohydrate, a protein, an oil, a fatty acid, or a vitamin). The metabolite can be a compound that is important for plant growth, development or homeostasis (for example, a phytohormone such as an auxin, cytokinin, gibberellin, a brassinosteroid, ethylene, or abscisic acid, a signaling molecule, or an antioxidant). In other embodiments, the metabolite can have other functions. For example, in one embodiment, a metabolite can have bacteriostatic, bactericidal, fungistatic, fungicidal or antiviral properties. In other embodiments, the metabolite can have insect-repelling, insecticidal, nematode-repelling, or nematicidal properties. In still other embodiments, the metabolite can serve a role in protecting the plant from stresses, may help improve plant vigor or the general health of the plant. In yet another embodiment, the metabolite can be a useful compound for industrial production. For example, the metabolite may itself be a useful compound that is extracted for industrial use, or serve as an intermediate for the synthesis of other compounds used in industry. In a particular embodiment, the level of the metabolite is increased within the agricultural plant or a portion thereof such that it is present at a concentration of at least 0.1 ug/g dry weight, for example, at least 0.3 ug/g dry weight, 1.0 ug/g dry weight, 3.0 ug/g dry weight, 10 ug/g dry weight, 30 ug/g dry weight, 100 ug/g dry weight, 300 ug/g dry weight, 1 mg/g dry weight, 3 mg/g dry weight, 10 mg/g dry weight, 30 mg/g dry weight, 100 mg/g dry weight or more, of the plant or portion thereof.

Likewise, the modulation can be a decrease in the level of a metabolite. The reduction can be in a metabolite affecting the taste of a plant or a commodity plant product derived from a plant (for example, a bitter tasting compound), or in a metabolite which makes a plant or the resulting commodity plant product otherwise less valuable (for example, reduction of oxalate content in certain plants, or compounds which are deleterious to human and/or animal health). The metabolite whose level is to be reduced can be a compound that affects quality of a commodity plant product (e.g., reduction of lignin levels).

In some embodiments, the endophyte is capable of generating a complex network in the plant or surrounding environment of the plant, which network is capable of causing a detectable modulation in the level of a metabolite in the host plant.

In a particular embodiment, the metabolite can serve as a signaling or regulatory molecule. The signaling pathway can be associated with a response to a stress, for example, one of the stress conditions selected from the group consisting of drought stress, salt stress, heat stress, cold stress, low nutrient stress, nematode stress, insect herbivory stress, fungal pathogen stress, complex pathogen stress, and viral pathogen stress.

The inoculated agricultural plant is grown under conditions such that the level of one or more metabolites is modulated in the plant, wherein the modulation is indicative of increased resistance to a stress selected from the group consisting of drought stress, salt stress, heat stress, cold stress, low nutrient stress, nematode stress, insect herbivory stress, fungal pathogen stress, complex pathogen stress, and viral pathogen stress. The increased resistance can be measured at about 10 minutes after applying the stress, for example about 20 minutes, 30 minutes, about 45 minutes, about 1 hour, about 2 hours, about 4 hours, about 8 hours, about 12 hours, about 16 hours, about 20 hours, about 24 hours, about 36 hours, about 48 hours, about 72 hours, about 96 hours, about 120 hours, or about a week after applying the stress.

The metabolites or other compounds described herein can be detected using any suitable method including, but not limited to gel electrophoresis, liquid and gas phase chromatography, either alone or coupled to mass spectrometry (See, for example, the Examples sections below), NMR (See e.g., U.S. patent publication 20070055456, which is incorporated herein by reference in its entirety), immunoassays (enzyme-linked immunosorbent assays (ELISA)), chemical assays, spectroscopy and the like. In some embodiments, commercial systems for chromatography and NMR analysis are utilized.

In other embodiments, metabolites or other compounds are detected using optical imaging techniques such as magnetic resonance spectroscopy (MRS), magnetic resonance imaging (MRI), CAT scans, ultra sound, MS-based tissue imaging or X-ray detection methods (e.g., energy dispersive x-ray fluorescence detection).

Any suitable method may be used to analyze the biological sample (e.g., seed or plant tissue) in order to determine the presence, absence or level(s) of the one or more metabolites or other compounds in the sample. Suitable methods include chromatography (e.g., HPLC, gas chromatography, liquid chromatography), mass spectrometry (e.g., MS, MS-MS), LC-MS, enzyme-linked immunosorbent assay (ELISA), antibody linkage, other immunochemical techniques, biochemical or enzymatic reactions or assays, and combinations thereof. The levels of one or more of the recited metabolites or compounds may be determined in the methods of the present invention. For example, the level(s) of one metabolites or compounds, two or more metabolites, three or more metabolites, four or more metabolites, five or more metabolites, six or more metabolites, seven or more metabolites, eight or more metabolites, nine or more metabolites, ten or more metabolites, or compounds etc., including a combination of some or all of the metabolites or compounds including, but not limited to those disclosed herein may be determined and used in such methods.

As shown in the Examples and otherwise herein, endophyte-inoculated plants display altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome relative to a reference plant, or a combination thereof. Therefore, in one embodiment, the endofungal endophytic population is disposed on the surface or on or within a tissue of the seed or seedling in an amount effective to increase the biomass of the plant, or a part or tissue of the plant grown from the seed or seedling. The increased biomass is useful in the production of commodity products derived from the plant. Such commodity products include an animal feed, a fish fodder, a cereal product, a processed human-food product, a sugar or an alcohol. Such products may be a fermentation product or a fermentable product, one such exemplary product is a biofuel. The increase in biomass can occur in a part of the plant (e.g., the root tissue, shoots, leaves, etc.), or can be an increase in overall biomass when compared with a reference agricultural plant. Such increase in overall biomass can be under relatively stress-free conditions. In other cases, the increase in biomass can be in plants grown under any number of abiotic or biotic stresses, including drought stress, salt stress, heat stress, cold stress, low nutrient stress, nematode stress, insect herbivory stress, fungal pathogen stress, complex pathogen stress, and viral pathogen stress.

In another embodiment, the endofungal endophytic population is disposed on the surface or within a tissue of the seed or seedling in an amount effective to increase the rate of seed germination when compared with a reference agricultural plant.

In other cases, the endofungal microbe is disposed on the seed or seedling in an amount effective to increase the average biomass of the fruit or cob from the resulting plant when compared with a reference agricultural plant.

Plants inoculated with an endofungal endophytic population may also show an increase in overall plant height. Therefore, in one embodiment, the present invention provides for a seed comprising an endofungal endophytic population that is disposed on the surface or within a tissue of the seed or seedling in an amount effective to increase the height of the plant. For example, the endofungal endophytic population is disposed in an amount effective to result in an increase in height of the agricultural plant when compared with a reference agricultural plant. Such an increase in height can be under relatively stress-free conditions. In other cases, the increase in height can be in plants grown under any number of abiotic or biotic stresses, including drought stress, salt stress, heat stress, cold stress, low nutrient stress, nematode stress, insect herbivory stress, fungal pathogen stress, complex pathogen stress, or viral pathogen stress.

The host plants inoculated with the endofungal endophytic population may also show dramatic improvements in their ability to utilize water more efficiently. Water use efficiency is a parameter often correlated with drought tolerance. Water use efficiency (WUE) is a parameter often correlated with drought tolerance, and is the $CO_2$ assimilation rate per amount of water transpired by the plant. An increase in biomass at low water availability may be due to relatively improved efficiency of growth or reduced water consumption. In selecting traits for improving crops, a decrease in water use, without a change in growth would have particular merit in an irrigated agricultural system where the water input costs were high. An increase in growth without a corresponding jump in water use would have applicability to all agricultural systems. In many agricultural systems where water supply is not limiting, an increase in growth, even if it came at the expense of an increase in water use also increases yield.

When soil water is depleted or if water is not available during periods of drought, crop yields are restricted. Plant water deficit develops if transpiration from leaves exceeds the supply of water from the roots. The available water supply is related to the amount of water held in the soil and the ability of the plant to reach that water with its root system. Transpiration of water from leaves is linked to the fixation of carbon dioxide by photosynthesis through the stomata. The two processes are positively correlated so that high carbon dioxide influx through photosynthesis is closely linked to water loss by transpiration. As water transpires from the leaf, leaf water potential is reduced and the stomata tend to close in a hydraulic process limiting the amount of photosynthesis. Since crop yield is dependent on the fixation of carbon dioxide in photosynthesis, water uptake and transpiration are contributing factors to crop yield. Plants which are able to use less water to fix the same amount of carbon dioxide or which are able to function normally at a low water potential, are more efficient and thereby are able to produce more biomass and economic yield in many agricultural systems. An increased water use efficiency of the plant relates in some cases to an increased fruit/kernel size or number.

Therefore, in one embodiment, the plants described herein exhibit an increased water use efficiency (WUE) when compared with a reference agricultural plant grown under the same conditions. Such an increase in WUE can occur under conditions without water deficit, or under conditions of water deficit, for example, when the soil water content is less than or equal to 60% of water saturated soil, for example, less than or equal to 50%, less than or equal to 40%, less than or equal to 30%, less than or equal to 20%, less than or equal to 10% of water saturated soil on a weight basis. In some embodiments, the plants inoculated with the endofungal endophytic population show increased yield under non-irrigated conditions, as compared to reference agricultural plants grown under the same conditions.

In a related embodiment, the plant comprising endophyte can have a higher relative water content (RWC), than a reference agricultural plant grown under the same conditions.

Although the present invention has been described in detail with reference to examples below, it is understood that various modifications can be made without departing from the spirit of the invention. For instance, while the particular examples below may illustrate the methods and embodiments described herein using a specific plant, the principles in these examples may be applied to any agricultural crop. Therefore, it will be appreciated that the scope of this invention is encompassed by the embodiments of the inventions recited herein and the specification rather than the specific examples that are exemplified below. All cited patents and publications referred to in this application are herein incorporated by reference in their entirety.

EXAMPLES

Example 1

Cultivation-Independent Analysis of Microbial Taxa in Agriculturally Relevant Seed Communities Based on Marker Gene High-Throughput Sequencing Example Description Microbial taxa found in agriculturally relevant communities were identified using high-throughput marker gene sequencing across several crops and numerous varieties of seeds.

Experimental Description

We employed high-throughput sequencing of marker genes for bacteria, archaea, and fungi on seeds of 50 commercial, 22 wild, and 33 landrace cultivars of corn; 40 commercial, 13 wild, and 23 landrace cultivars of wheat; 13 cotton seeds; and 24 soybean seeds. Non-commercial varieties were obtained from USDA GRIN through their National Plant Germplasm system (http://www.ars-grin.gov/npgs/). Accessions were categorized into landrace, wild, and inbred varieties based on the assessment of improvement status. In order to extract microbial DNA, the seeds were first soaked in sterile, DNA-free water for 48 h to soften them, and they were surface sterilized using 95% ethanol to reduce superficial contaminant microbes. The seeds were then ground using a mortar and pestle treated with 95% ethanol and RNAse Away (Life Technologies, Inc., Grand Island, N.Y.) to remove contaminant DNA. DNA was extracted from the ground seeds using the PowerPlant Pro DNA extraction kit (Mo Bio Laboratories, Inc., Carlsbad, Calif.) according to the manufacturer's instructions.

Marker genes were amplified and sequenced from the extracted DNA using a high-throughput protocol similar to (Fierer et al. 2012, McGuire et al. 2013). For the bacterial and archaeal analyses, the V4 hypervariable region of the 16S rRNA gene was targeted (primers 515f/806r), and for fungi, the first internal transcribed spacer (ITS1) region of the rRNA operon (primers ITS1f/ITS2r) was targeted. The two marker genes were PCR amplified separately using 35 cycles, and error-correcting 12-bp barcoded primers specific to each sample were used to facilitate combining of samples. To reduce the amplification of chloroplast and mitochondrial DNA, we used PNA clamps specific to the rRNA genes in these organelles (Lundberg et al. 2013). PCR reactions to amplify 16S rRNA genes followed the protocol of (Lundberg et al. 2013), and those to amplify ITS regions followed the protocol of (Fierer et al. 2012). PCR products were quantified using the PicoGreen assay (Life Technologies, Inc., Grand Island, N.Y.), pooled in equimolar concentrations, and cleaned using the UltraClean kit (Mo Bio Laboratories, Inc., Carlsbad, Calif.). Cleaned DNA pools were sequenced on an Illumina MiSeq instrument at the University of Colorado Next Generation Sequencing Facility.

Old OTU Assignment

The raw sequence data were reassigned to distinct samples using a custom Python script, and quality filtering and OTU (operational taxonomic unit) clustering was conducted using the UPARSE pipeline (Edgar 2013). Briefly, a de novo sequence database with representative sequences for each OTU was created using a 97% similarity threshold, and raw reads were mapped to this database to calculate sequence counts per OTU per sample. Prior to creating the database, sequences were quality filtered using an expected error frequency threshold of 0.5 errors per sequence. In addition, sequences were dereplicated and singletons were removed prior to creating the database. OTUs were provided taxonomic classifications using the RDP classifier (Wang et al. 2007) trained with the Greengenes (McDonald et al. 2012) or UNITE (Abarenkov et al. 2010) databases for 16S rRNA and ITS sequences, respectively. To account for differences in the number of sequences per sample, each sample was rarefied to 1,000 and 6,500 sequences per sample for 16S rRNA and ITS datasets. This resulted in samples with fewer sequences than the rarefaction depth to be discarded from downstream analyses. OTUs classified as chloroplasts or mitochondria were discarded prior to rarefaction.

New OTU Assignment

For both 16S rRNA and ITS1 sequences, we used barcoded primers unique to each sample to combine multiple samples in an Illumina MiSeq run. The resulting reads were separated back into their respective samples based on the barcodes using a custom Python script. We performed quality filtering following the UPARSE pipeline (Edgar, 2013), including merging paired end reads, setting a maximum expected error rate of <=1 error per merged sequence, and removing singletons (reads occurring only one across all samples in a run).

The original de novo OTU (operational taxonomic units) clustering was performed at 97% sequence similarity, again following the UPARSE pipeline. Subsequent New OTU (new OTU) clustering (Rideout et al, 2014) was performed using a cascading approach, comparing the sequences against the Greengenes (McDonald et al, 2012) and UNITE (Abarenkov et al, 2010) databases, which are provided with full-length clustering at various widths. Bacterial sequences were first compared to the Greengenes 99% OTU representative sequences. Sequences without a 99% match to the 99% OTUs were then compared to the Greengenes 97% OTUs at 97%. Fungal sequences were first compared to the UNITE Dynamic OTU representative sequences, where dynamic represents values between 97% and 99% depending on the OTU. Sequences that did not match the UNITE Dynamic OTUs at the appropriate clustering level, were compared to the UNITE 97% OTUs at 97%. The remaining sequences that did not match either Greengenes or UNITE, and were present at a level of at least 10 reads across the samples, were clustered using the de novo method above (independently for the bacterial and fungal sequences). The original sequences were mapped to the New OTUs using the same cascading approach, and any sequences that did not match an OTU, but did match a sequence with fewer than 10 copies were designated with the read ID representing that unique sequence.

The original de novo OTUs were provided taxonomic classifications using the RDP classifier (Wang et al. 2007) trained with the Greengenes (McDonald et al. 2012) and UNITE (Abarenkov et al. 2010) databases for 16S rRNA and ITS sequences, respectively. To account for differences in the variable number of sequences per sample, each sample was rarefied to 1000 16S rRNA and 1000 ITS sequences per sample. OTUs classified as chloroplasts or mitochondria were discarded prior to rarefaction.

Overall differences in bacterial community composition between the control and inoculated plants were evaluated using non-metric multidimensional scaling based on Bray-Curtis dissimilarities in order to visualize pairwise differences between sample communities. Permutational analysis of variance (PERMANOVA) was used to statistically test the significance of these differences. Analyses were conducted using the vegan package in R (R Core Team 2013). To determine the OTUs contributing to overall differences among crop types, mean relative abundances were calculated for each OTU within each crop type. Only OTUs with a mean relative abundance of 0.1% in either group were included in this analysis. The tables demonstrating presence absence were constructed using the New OTUs, assessing the presence of each OTU in any of the sample replicates, and reporting only the OTUs matching the relevant sequences.

Example Results: Core Taxa

OTUs were determined to be core taxa based on detection across a variety of seed types. For example, taxa core across crops were those present in seeds from ≥2 crops. Similarly, taxa core to an individual crop were those present in seeds from ≥2 cultivar categories (i.e. wild, landrace, inbred, or modern) within that crop. In an effort to conservatively select extant core taxa, OTUs where at least class level taxonomy could be resolved were discarded. Representative strains from our strain collection for each OTU were determined when possible using 16S rRNA gene clustering at the 97% similarity threshold in USEARCH (Edgar 2010).

Across seeds from all crops (corn, wheat, cotton, and soybean), 2,697 bacterial and 415 fungal OTUs were detected and evaluated following our stringent sequence quality filtering approach. Fungal sequences were not detectable in soybean samples, and thus, analyses across fungal taxa were conducted within the 3 remaining crops.

Within cotton, 176 bacterial and 68 fungal OTUs were found (Table 1B). Among these, 50 taxa, consisting of 25 bacterial and 25 fungal OTUs, were found only in cotton seeds, and not in seeds of corn, wheat, or soybean (Table 1A).

Within corn, 2351 OTUs were found, including 2169 bacterial OTUs and 182 fungal OTUs (Table 2C). Among these, 1964 OTUs, including 1853 bacterial OTUs and 111 fungal OTUs, were found only in corn, and not in seeds of wheat, soybean, or cotton seeds tested (Table 2A). OTUs that were found to co-occur within corn seeds with a correlation of more than 0.5 are found in Table 2B.

Within soybeans, 1097 bacterial OTUs were found (Table 3C). Among these, 367 bacterial taxa were found only in soybean, and not in seeds of corn, wheat, or cotton seeds tested (Table 3A). OTUs that were found to co-occur within soy seeds with a correlation of more than 0.5 are found in Table 3B.

Within wheat, 557 OTUs were found, including 354 bacterial OTUs and 203 fungal OTUs (Table 4C). Among these, 226 OTUs, including 85 bacterial OTUs and 149 fungal OTUs, were found only in wheat, and not in seeds of corn, soybean, or cotton seeds tested (Table 4A). OTUs that were found to co-occur within wheat seeds with a correlation of more than 0.5 are found in Table 4B.

Example Results: Ancestral Vs. Modern Taxa

Overall bacterial and fungal community compositions were compared between ancestral and modern seeds by first visualizing differences using non-metric multidimensional scaling based on Bray-Curtis dissimilarities. Statistical significance of differences was tested using permutational multivariate analysis of variance (PERMANOVA) with the vegan package in R (R Core Team 2013 R: A Language and Environment for Statistical Computing. R Foundation for Statistical Computing, Vienna, Austria ISBN: 3-900051-07-0. Available online at http://www.R-project.org/). The Shannon-Wiener diversity index was also calculated with the vegan package in R. OTUs having greater associations with ancestral seed types compared to modern seeds were identified using comparisons of the relative abundances of OTUs. Specifically, sequence counts per OTU were converted to relative abundances and median relative abundances were calculated for each seed type. We assessed differences between ancestral and modern seeds when median relative abundances were ≥0.1%. OTUs without taxonomy resolved to at least class level were removed from analysis. Representative strains from the current strain collection were found fNew OTUs when possible using 16S rRNA sequence clustering at the 97% threshold in USEARCH v7.0 [Edgar (2010) Nature methods 10:996-8, incorporated herein by reference]. Bacterial community composition significantly differed between wild and modern seeds for both corn (P<0.001; FIG. 1A) and wheat (P<0.001; FIG. 1B). This was also the case when landrace and modern seeds were compared (P<0.05).

Figure 3:
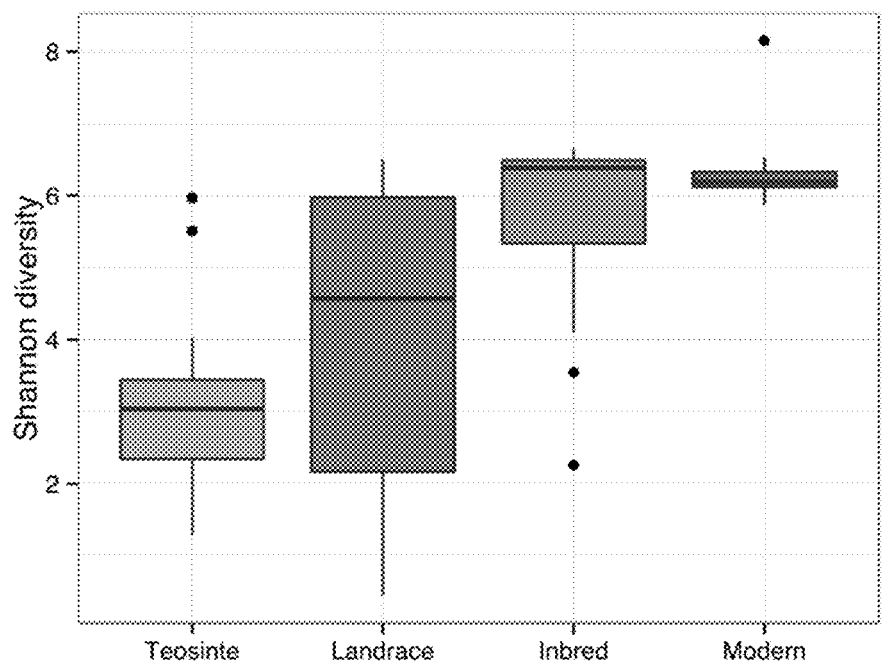
FIG. 3. Differences in seed bacterial diversity among various cultivars of corn. Shown are the Shannon Diversity indices of bacterial communities found in Teosinte, Landrace, Inbred and Modern cultivars of corn.

Among corn seeds, 14 bacterial OTUs were overrepresented in wild compared to modern seed varieties. These taxa included several members of the Enterobacteriaceae family as well as Paenibacillaceae, Planococcaceae, and Oxalobacteraceae (Table 16). Similarly, six OTUs were overrepresented in landrace compared to modern corn seeds. These also included several Enterobacteriaceae as well as one Xanthomonadaceae (Table 17). All these differences in composition were translated into differences in diversity, with modern corn being significantly more diverse than Teosinte and the Landrace (FIG. 3).

Figure 4:
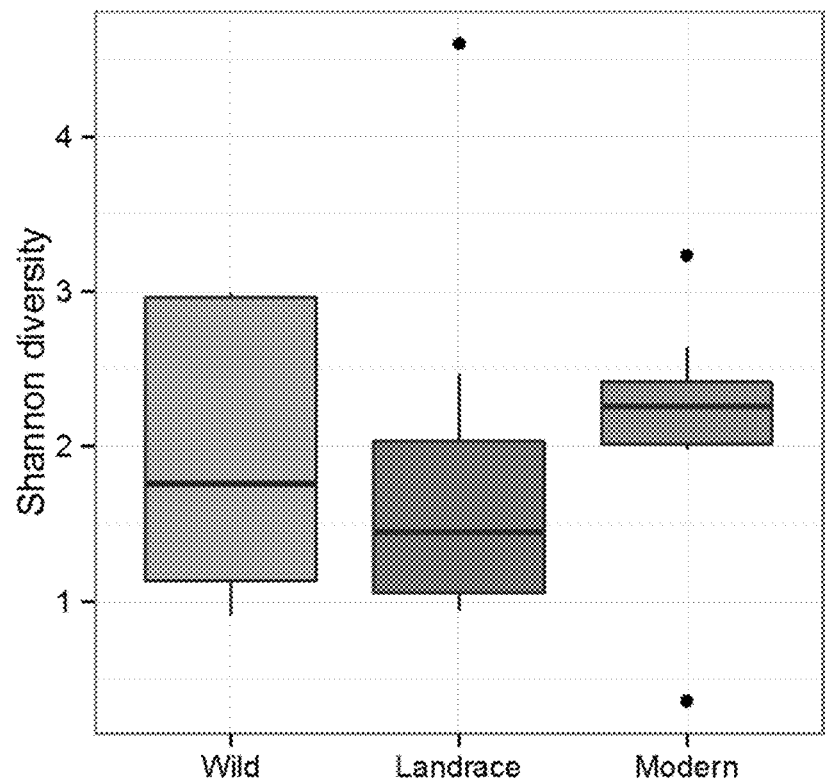
FIG. 4. Differences in seed bacterial diversity among various cultivars of wheat. Shown are the Shannon Diversity indices of bacterial communities found in Wild, Landrace and Modern cultivars of wheat.

Among wheat seeds, 5 bacterial OTUs were overrepresented in wild compared to modern seed varieties (Table 18). 3 OTUs were overrepresented in landrace compared to modern wheat seeds. There taxa were members of the Enterobacteriaceae (OTU_3078, OTU_2, and OTU_2912). (Table 19). The diversity of the bacterial community was higher in modern wheat than in the Landrace (FIG. 4).

Figure 5:
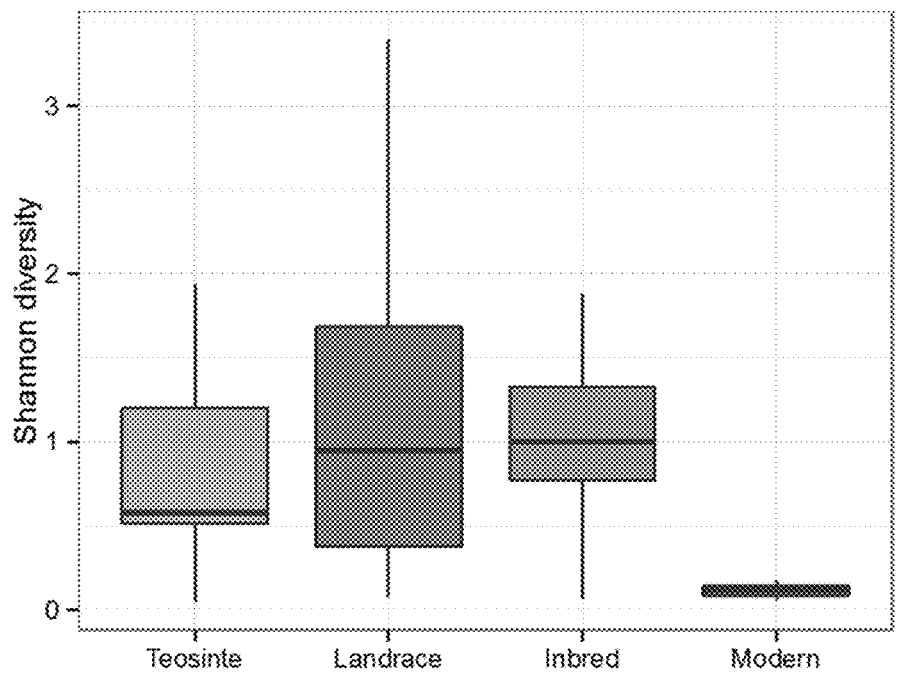
FIG. 5. Differences in seed fungal diversity across different cultivars of corn. Shown are the Shannon Diversity indices of fungal communities found in Teosinte, Landrace, Inbred and Modern cultivars of corn, illustrating the lower diversity of fungal communities within modern corn.
Figure 6:
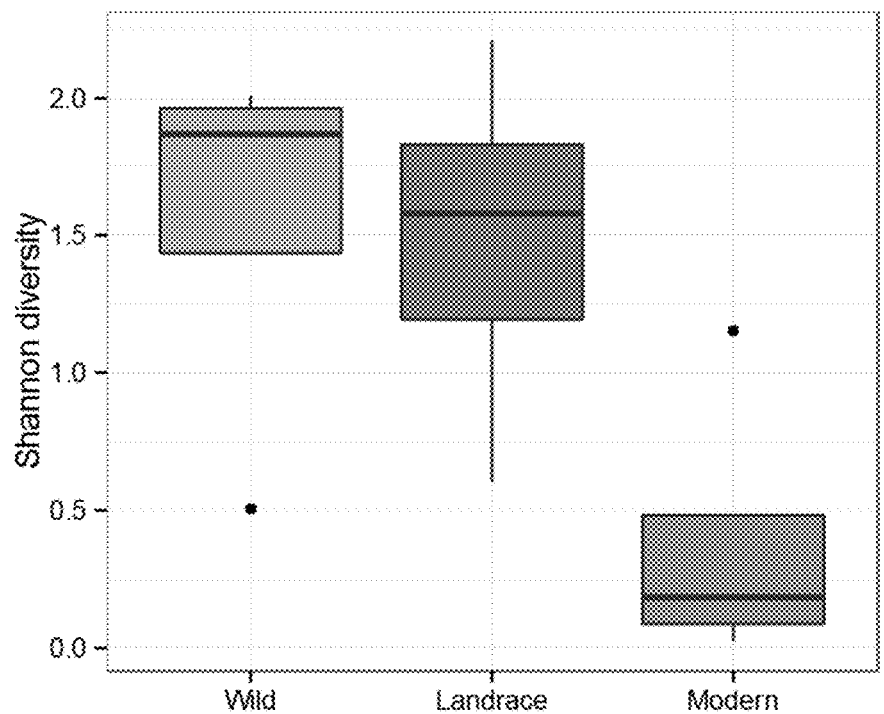
FIG. 6. Differences in seed fungal diversity across different cultivars of wheat. Shown are the Shannon Diversity indices of fungal communities found in Wild, Landrace and Modern cultivars of wheat which, as with corn, demonstrate a reduced diversity of fungal communities within modern corn.

Seed fungal communities were also diverse, although less so than bacterial communities (FIGS. 5 and 6). The pattern of diversity was opposite to that observed among the bacterial communities, with the modern varieties containing the least diverse fungal communities. Over 500 unique OTUs were observed across all samples. Fungal community composition significantly differed between wild and modern seeds from wheat P<0.001; Fig. XB). This was also the case for landrace and modern seeds from wheat. Differences between wild and modern seeds were not significantly different for corn (P>0.01; Fig. XA), but this was likely due to insufficient replication.

Among corn seeds, 1 fungal OTU was overrepresented in wild compared to modern seed varieties. This OTU was classified as an *Acremonium* species (Table 20). 2 fungal OTUs were overrepresented in landrace compared to modern seed varieties. Both OTUs were members of the Sordariomycetes and one was the same *Acremonium* species as that overrepresented in wild compared to modern seeds (Table 21).

Among wheat seeds, 7 fungal OTUs were overrepresented in wild compared to modern seed varieties. These OTUs were all members of the Dothideomycetes and included 3 taxa identified as *Cladosporium* (Table 22). Two of these OTUs were also overrepresented in landrace compared to modern seed varieties (Table 23).

FIGS. 3 and 4 show the Shannon Diversity indices of bacterial communities found in Wild, Landrace, and modern cultivars of corn and wheat, respectively. FIGS. 5 and 6 show the Shannon Diversity indices of fungal communities found in Teosinte, Landrace, Inbred, and modern cultivars of corn and wheat, respectively. Modern corn and wheat each had a lower diversity of fungal communities.

In conclusion, we have identified a number of bacterial and fungal microbes present in ancestral and landrace cultivars of wheat and corn that are underrepresented in modern cultivars. Our analysis elucidated several bacterial and fungal OTUs that were overrepresented in ancestral seeds compared to modern seeds.

Example 2

Identification of Root Endophytes Belonging to OTUs Identified in Seeds

In the above examples, microbial taxa core to agriculturally relevant seeds were identified. In this example, seeds from several crops and numerous varieties were grown in the greenhouse or the field, and community sequencing was performed on root samples to identify taxa corresponding to core seed taxa.

Experimental Description

The crops used in this experiment were designated: Modern Maize 1, Modern Maize 2, Landrace Maize, Wild Maize, Modern Wheat 1, Modern Wheat 2, Landrace Wheat, Wild Wheat, Modern Soy 1, Modern Soy 2, Wild Soy 1, Wild Soy 2, Modern Cotton 1, Modern Cotton 2, Landrace Cotton, and Wild Cotton.

The purpose of this work was to use Illumina sequencing to define the bacterial and fungal endophyte populations residing in the roots of wild, landrace, and modern varieties of maize, wheat, soybean, and cotton when grown in two different greenhouses (designated as "Massachusetts" or "Texas") or in three geographically different field locations (Minnesota and Idaho). As a negative control to promote enrichment for seed transmitted endophytes, plants were grown in autoclaved (sterile) sand under controlled conditions in the Massachusetts greenhouse. To see if seed transmitted endophytes might persist in roots grown in soil, all the above listed genotypes of plant were grown in the Massachusetts greenhouse planted with commercial nursery soil from Massachusetts. To see if some of these modern varieties would maintain seed transmitted endophytes in roots when grown in a different greenhouse, Modern Cotton 1 and 2, Modern Soy 1 and 2, Modern Maize 1 and 2, and Modern Wheat 1 and 2 were planted in clean containers filled with wheat field soil from Texas, in a greenhouse in Texas. To see if some of these modern varieties would maintain seed transmitted endophytes in roots when grown in geographically different field locations, Modern Cotton 1 and 2, Modern Soy 1 and 2, Modern Maize 1 and 2, and Modern Wheat 1 and 2 were planted in wheat fields in Minnesota and Idaho.

New, plastic containers were filled with heat sterilized quartz sand prior to each seed being per accession being planted. For soil treatments in Massachusetts, heat sterilized quartz sand was mixed with soil in a ratio of 3:1. For soil treatments in Texas, containers were filled with unmixed wheat field soil. To pre-germinate seedlings in Massachusetts, unsterilized seeds of each accession were placed on sterile sand or pure soil in a Petri dish, then watered with sterile water. One seedling of each seedling of each accession was planted in each of 4 sterile sand filled containers, 4 sand:soil filled containers or 4 soil filled containers. In the Texas greenhouse, seeds were placed directly into the soil in cups, without pre-germination. Likewise at the Minnesota and Idaho field locations, seeds were placed into the ground without pregermination. Greenhouse grown seedlings were watered with 25 mL of sterile water every two days, while field grown plants were only watered once with tap water right after planting. Plants were grown for 21 days in Massachusetts and then harvested, while in Texas, Minnesota and Idaho they were grown for 14 days then harvested.

Harvesting involved shaking plants free of as much soil/debris as possible, cutting plants into shoot and root, placing them into 15 mL conical tubes along with 10 mL of distilled water, shaken vigourously, then decanting off the dirty water. This washing step was repeated with sterile water until wash water was no longer cloudy (the last rinse coming off of every root was clear). The washed root material in 15 mL conical tube then had added to it two sterile carbide beads and 5 mL of sterile water before homogenizing in the Fastprep24 machine for 1 minute at 6M vibrations per second.

DNA was extracted from this material using a PowerPlant® Pro-htp 96 DNA extraction kit (Mo Bio Laboratories, Inc., Carlsbad, Calif.) according to the manufacturer's instructions. Microbial composition was assessed in each sample using the methods described in Example 1.

The original de novo OTU (operational taxonomic units) clustering was performed at 97% sequence similarity, again following the UPARSE pipeline. Subsequent "New OTU" clustering (Rideout et al, 2014) was performed using a cascading approach, comparing the sequences against the Greengenes (McDonald et al, 2012) and UNITE (Abarenkov et al, 2010) databases, which are provided with full-length clustering at various widths. Bacterial sequences were first compared to the Greengenes 99% OTU representative sequences. Sequences without a 99% match to the 99% OTUs were then compared to the Greengenes 97% OTUs at 97%. Fungal sequences were first compared to the UNITE Dynamic OTU representative sequences, where dynamic represents values between 97% and 99% depending on the OTU. Sequences that did not match the UNITE Dynamic OTUs at the appropriate clustering level, were compared to the UNITE 97% OTUs at 97%. The remaining sequences that did not match either Greengenes or UNITE, and were present at a level of at least 10 reads across the samples, were clustered using the de novo method above (independently for the bacterial and fungal sequences). The original sequences were mapped to the New OTUs using the same cascading approach, and any sequences that did not match an OTU, but did match a sequence with fewer than 10 copies were designated with the read ID representing that unique sequence.

The original de novo OTUs were provided taxonomic classifications using the RDP classifier (Wang et al. 2007) trained with the Greengenes (McDonald et al. 2012) and UNITE (Abarenkov et al. 2010) databases for 16S rRNA and ITS sequences, respectively. To account for differences in the variable number of sequences per sample, each sample was rarefied to 1000 16S rRNA and 1000 ITS sequences per sample. OTUs classified as chloroplasts or mitochondria were discarded prior to rarefaction.

Overall differences in bacterial community composition between the control and inoculated plants were evaluated using non-metric multidimensional scaling based on Bray-Curtis dissimilarities in order to visualize pairwise differences between sample communities. Permutational analysis of variance (PERMANOVA) was used to statistically test the significance of these differences. Analyses were conducted using the vegan package in R (R Core Team 2013). To determine the OTUs contributing to overall differences among crop types, mean relative abundances were calculated for each OTU within each crop type. Only OTUs with a mean relative abundance of 0.1% in either group were included in this analysis. The tables demonstrating presence absence were constructed using the new OTUs, assessing the presence of each OTU in any of the sample replicates, and reporting only the OTUs matching the relevant sequences.

Example Results

Experiments previously detected 2,697 bacterial and 415 fungal OTUs in seeds of corn, wheat, cotton, and soybean. Bacterial taxa represented 218 families and 334 genera. Fungal taxa represented 48 families and 87 genera highlighting the broad diversity of endophytic microbes within seeds. Searching for these same OTUs in washed roots of corn, wheat, cotton, and soybeans grown in either Massachusetts or Texas greenhouse and Idaho or Minnesota field, 624 (23%) of the bacterial and 48 (12%) of the fungal OTUs were observed in seeds. Searching for these only in roots of plants grown in the Massachusetts greenhouse (Tables 25, 26), 176 (7%) of these bacterial and 33 (8%) of these fungal OTUs were detected. In roots of plants grown in the Texas greenhouse (Tables 27, 28), 395 (15%) of these bacterial and 21 (5%) of these fungal OTUs were detected. In roots of plants grown in the Idaho field (Tables 29, 30), 364 (13%) of these bacterial and 14 (3%) of these fungal OTUs were detected. In roots of plants grown in the Minnesota field (Tables 31, 32), 335 (12%) of these bacterial and 13 (3%) of these fungal OTUs were detected.

Among all the previously detected seed OTUs, 68 bacterial OTUs and 27 fungal OTUs were found to be core taxa across crops (Tables 13, 14). Searching for these core OTUs in roots of plants grown in the Massachusetts greenhouse (Tables 25, 26), 27 (40%) of the bacterial and 6 (22%) of the fungal OTUs were detected. In roots of plants grown in the Texas greenhouse (Tables 27, 28), 38 (56%) of these core bacterial and 5 (19%) of these core fungal OTUs were detected. In roots of plants grown in the Idaho field (Tables 29, 30), 24 (35%) of these core bacterial and 5 (19%) of these core fungal OTUs were detected. In roots of plants grown in the Minnesota field (Tables 31, 32), 36 (53%) of these core bacterial and 6 (22%) of these core fungal OTUs were detected. Searching for core seed OTUs that occurred in at least one root sample of the greenhouses and fields, 49 (72%) of bacterial and 7 (26%) of fungal OTUs were detected. Among these, the most common bacterial seed OTUs also observed in roots were B0.9|GG99|128181 (observed in 100% of all samples), B0.9|GG99|73880 (observed in 96% of all samples) B0.9|GG99|25580 (observed in 90% of all samples) and B0.9|GG99|132333 (observed in 84% of all samples). Among fungal OTUs from seeds, the most commonly observed in roots were F0.9|UDYN|206476 (observed in 76% of all samples), F0.9|UDYN|212600 (observed in 46% of all samples) F0.9|UDYN|216250 (observed in 42% of all samples) and F0.9|UDYN|215392 (observed in 42% of all samples). The fungal SYM Strains 15926, 15928, 00120, 00880, 01325, 01326, 01328, and 15811 all have greater than 97% identity to OTU F0.9|UDYN|206476 and were assayed on seedlings. The fungal SYM Strains 00741b, 01315, 01327, and 15890 all have greater than 97% identity to OTU F0.9|UDYN|212600 and were assayed on seedlings. The fungal SYM Strains 00154, 15825, 15828, 15837, 15839, 15870, 15872, 15901, 15920, 15932, and 15939 all have greater than 97% identity to F0.9|UDYN|215392 and were assayed on seedlings. The core seed and root bacteria observed in these experiments belong to the Phyla Acidobacteria, Actinobacteria, Bacteroidetes, Firmicutes, Proteobacteria, and Tenericutes, while the fungal belong to the Phyla Ascomycota and to the of the Classes Dothideomycetes and Sordariomycetes, which means these groups poses the capacity to be seed transmitted and to colonize different life stages of a plant (both seeds and roots), as well as having a broad host range and flexibility allowing them to exist within different species of plant.

29 seed bacterial OTUs were observed in roots of plants grown on sterile sand, while 43 seed bacterial OTUs were observed in roots of plants grown in soil; 23 of the same seed OTUs were observed in both conditions (Tables 25, 26). This pattern means that the soil condition enhances colonization of seed transmitted bacteria into the root. A contrasting trend was observed for fungi, where 28 seed bacterial OTUs were observed in roots of plants grown on sterile sand, while 19 seed bacterial OTUs were observed in roots of plants grown in soil; 15 of the same seed OTUs were observed in both conditions. Unlike bacteria, seed transmitted fungi attempting to colonize roots growing in non-sterile soil face greater competition for the root niche as soil transmitted fungi attempt to colonize the root.

Some seed endophytes are especially robust and able to colonize roots of plants growing in different field and greenhouse environments. By counting OTUs of microbes occurring in at least one plant variety in each field and the Texas greenhouse, 163 bacterial OTUs (out of a total of 583 bacterial seed OTUs detected in field grown roots) and 8 fungal OTUs (out of a total of 28 fungal seed OTUs detected in roots) were observed occurring in roots of these plants in all three environments; these sequences represent robust root colonizers which persist in roots despite different environmental conditions.

Root microbiomes in both environments shared 45% of their bacterial seed OTUs (216 OTUs) and 50% of their fungal seed OTUs (9 OTUs). As these plants were harvested when they were two weeks old, approximately half the diversity of seed transmitted microbiomes in maize, wheat and soy seeds are able to colonize and persist in seedlings under agronomically relevant conditions for at least two weeks.

Among all the previously detected seed OTUs found in corn seeds, 20 bacterial OTUs and 3 fungal OTUs were found to be present only seeds of wild and ancient landraces, but not modern varieties of corn. Searching for these in roots of ancestral maize varieties grown on sterile sand in the Massachusetts greenhouse, bacterial OTUs B0.9|GG99|813062, B0.9|GG99|9943, and B0.9|GG99|4327501 (but no fungal OTUs) were detected in wild maize, and bacterial OTU B0.9|GG99|9943 and fungal OTU F0.9|UDYN|210204 was detected in ancient landrace maize (Tables 25, 26). No ancestral seed bacterial OTU was observed in roots of wild or landrace maize plants grown on soil in the Massachusetts greenhouse, however fungal OTU F0.9|UDYN|210204 was observed in the roots of the ancient landrace maize growing on soil (Tables 25, 26).

Example 3

Isolation of Bacterial Endophytes from Ancestral Seeds

In order to better understand the role played by seed-derived endophytic microbes from ancestral species of plants in improving the vigor, general health and stress resilience of modern host plants, we initiated a systematic screen to isolate and characterize endophytic microbes from seeds of commercially significant grass plants.

Diverse types of wild relatives or ancestral landraces of maize, wheat, rice, and other seeds were acquired and screened for cultivatable microbes.

Pools of 5 seeds were soaked in 10 mL of sterile water contained in sterile 15 mL conical tubes for 24 hours. Some maize and rice accessions were sampled for seed surface microbes. In these cases, after 24 hours of soaking, 50 µL aliquots of undiluted, 100× dilute and 10000× dilute soaking water was plated onto R2A agar [Proteose peptone (0.5 g/L), Casamino acids (0.5 g/L), Yeast extract (0.5 g/L), Dextrose (0.5 g/L) Soluble starch (0.5 g/L), Dipotassium phosphate (0.3 g/L), Magnesium sulfate 7$H_2O$ (0.05 g/L), Sodium pyruvate (0.3 g/L), Agar (15 g/L), Final pH 7±0.2 @ 25° C.] to culture oligotrophic bacteria, while the same volumes and dilutions were also plated onto potato dextrose agar (PDA) [Potato Infusion from 200 g/L, Dextrose 20 g/L, Agar 15 g/L, Final pH: 5.6±0.2 at 25° C.] to culture copiotrophic bacteria and fungi. All seeds in the study were sampled for endophytes by surface sterilization, trituration, and culturing of the mash. Seeds were surface sterilized by washing with 70% EtOH, rinsing with water, then washing with a 3% solution of sodium hypochlorite followed by 3 rinses in sterile water. All wash and rinse steps were 5 minutes with constant shaking at 130 rpm. Seeds were then blotted on R2A agar which was incubated at 30° C. for 7 days in order to confirm successful surface sterilization. Following the sterilization process, batches of seeds were ground with a sterile mortar and pestle in sterile R2A broth, while a select number of surface sterilized maize, rice and soy seeds were grown in sterile conditions and the roots or shoots of seedlings (without further sterilization) were crushed by bead beating in a Fastprep24 machine with 3 carbide beads, 1 mL of R2A in a 15 mL Falcon tube shaking at 6M/s for 60 seconds. Extracts of surface washes, crushed seed, or macerated seedling tissue were serially diluted by factors of 1 to $10^{-3}$ and spread onto quadrants on R2A and PDA agar in order to isolate cultivable seed-borne microorganisms. Plates were incubated at 28° C. for 7 days, monitoring for the appearance of colonies daily. After a week, plates were photographed and different morphotypes of colonies were identified and labeled. These were then selected for identification by sequencing, backing up as glycerol stock, and assaying for beneficial functions as described herein.

Plating and Scoring of Microbes

After 7 days of growth, most microbial colonies had grown large and distinct enough to allow differentiation based on colony size, shape, color and texture. Photographs of each plate were taken, and on the basis of color and morphotype, different colonies were identified by number for later reference. These strains were also streaked out onto either R2A or PDA to check for purity, and clean cultures were then scraped with a loop off the plate, resuspended in a mixture of R2A and glycerol, and frozen away in quadruplicate at −80° C. for later.

Sequence Analysis & Phylogenetic Assignment of Microbes Isolated from Ancestral Seeds To accurately characterize the isolated microbial endophytes, colonies were submitted for marker gene sequencing, and the sequences were analyzed to provide taxonomic classifications. Colonies were subjected to 16S rRNA gene PCR amplification using the 27f/1492r primer set, and Sanger sequencing of paired ends was performed at Genewiz (South Plainfield, N.J.). Raw chromatograms were converted to sequences, and corresponding quality scores were assigned using TraceTuner v3.0.6beta (U.S. Pat. No. 6,681,186, incorporated herein by reference). These sequences were quality filtered using PRINSEQ v0.20.3 [Schmieder and Edwards (2011) Bioinformatics. 2011; 27:863-864, incorporated herein by reference] with left and right trim quality score thresholds of 30 and a quality window of 20 bp. Sequences without paired reads were discarded from further processing. Paired end quality filtered sequences were merged using USEARCH v7.0 [Edgar (2010) Nature methods 10:996-8]. Taxonomic classifications were assigned to the sequences using the RDP classifier [Wang et al., (2007) Applied and environmental microbiology 73:5261-7, incorporated herein by reference] trained on the Greengenes database [McDonald et al. (2012), ISME journal 6:610-8, incorporated herein by reference]. The resulting 253 microbes, derived from ancestral (wild or ancient landraces) representing over 41 distinct OTUs (using a 97% similarity threshold) are provided in Table 24.

Example 4

Characterization of Bacterial Endophytes Isolated from Ancestral Seeds

A total of 140 seed-origin bacterial endophytes were seeded onto 96 well plates and tested for various activities and/or production of compounds, as described below. The results of these in vitro assays are summarized in Table 31.

TABLE 31

(Summnary of in vitro characterization of bacterial endophytes isolated from ancestral seeds)

| Sym Strain ID | Source | SEQ ID NO: | Antagonize E. coli | Antagonize S. cerevisae | Shows Cellulolytic activity | Secretes siderophores | Phosphate Solubilization | Growth on Nitrogen Free LGI | ACC Deaminase Activity | Produces Auxin/Indoles | Produces Acetoin |
|---|---|---|---|---|---|---|---|---|---|---|---|
| SYM00033 | Wild relative | 3117 | 0 | 0 | 1 | 1 | 2 | No | 0 | 3 | 0 |
| SYM00620 | Wild relative | 3159 | 0 | 1 | 1 | 0 | 1 | No | 0 | 2 | 2 |
| SYM00176 | Wild relative | 3154 | 1 | 0 | 1 | 2 | 1 | No | 0 | 2 | 1 |
| SYM00658 | Wild relative | 3139 | 1 | 1 | 1 | 0 | 2 | No | 1 | 2 | 3 |
| SYM00660 | Wild relative | 3127 | 0 | 1 | 2 | 1 | 0 | No | 1 | 0 | 1 |
| SYM00011 | Wild relative | 3123 | 0 | 0 | 0 | 0 | 1 | Yes | 0 | 2 | 0 |
| SYM00011b | Wild relative | 3245 | 0 | 0 | 0 | 0 | 0 | No | 0 | 0 | 1 |
| SYM00069 | Wild relative | 3232 | 0 | 0 | 0 | 0 | 0 | No | 0 | 0 | 2 |
| SYM00013 | Wild relative | 3160 | 0 | 0 | 2 | 2 | 0 | Yes | 0 | 2 | 0 |
| SYM00014 | Wild relative | 3165 | 0 | 0 | 2 | 1 | 0 | Yes | 0 | 2 | 0 |
| SYM00062 | Wild relative | 3155 | 0 | 0 | 2 | 2 | 0 | No | 1 | 2 | 0 |
| SYM00068 | Wild relative | 3140 | 0 | 0 | 2 | 2 | 1 | No | 3 | 2 | 0 |
| SYM00657 | Wild relative | 3156 | 0 | 0 | 2 | 0 | 0 | No | 3 | 2 | 0 |
| SYM00672 | Wild relative | 3144 | 0 | 0 | 2 | 2 | 1 | No | 3 | 1 | 0 |
| SYM00178 | Ancient Landrace | 3196 | 0 | 0 | 1 | 1 | 0 | No | 0 | 0 | 1 |
| SYM00722 | Ancient Landrace | 3197 | 0 | 0 | 1 | 0 | 0 | No | 1 | 1 | 0 |
| SYM00013b | Wild relative | 3246 | 0 | 0 | 0 | 0 | 0 | No | 0 | 0 | 1 |
| SYM00180 | Ancient Landrace | 3247 | 0 | 0 | 0 | 0 | 0 | No | 0 | 0 | 1 |
| SYM00181 | Ancient Landrace | 3233 | 0 | 0 | 0 | 0 | 0 | No | 0 | 0 | 2 |
| SYM00525 | Wild relative | 3218 | 0 | 0 | 0 | 0 | 0 | No | 0 | 2 | 1 |
| SYM00716 | Ancient Landrace | 3219 | 0 | 0 | 0 | 0 | 0 | No | 1 | 1 | 1 |
| SYM00731B | Ancient Landrace | 3234 | 0 | 0 | 0 | 0 | 0 | No | 1 | 1 | 0 |
| SYM00597 | Ancient Landrace | 3198 | 0 | 0 | 0 | 0 | 1 | No | 0 | 0 | 3 |
| SYM00022 | Wild relative | 3181 | 0 | 0 | 1 | 1 | 0 | No | 0 | 2 | 0 |
| SYM00025 | Ancient Landrace | 3182 | 0 | 0 | 1 | 0 | 0 | No | 0 | 2 | 1 |
| SYM00047 | Ancient Landrace | 3172 | 0 | 0 | 1 | 0 | 2 | No | 0 | 1 | 1 |
| SYM00055 | Ancient Landrace | 3183 | 0 | 0 | 1 | 1 | 2 | No | 0 | 0 | 0 |
| SYM00081 | Ancient Landrace | 3173 | 0 | 0 | 1 | 1 | 2 | Yes | 0 | 1 | 0 |
| SYM00094 | Ancient Landrace | 3166 | 0 | 0 | 1 | 1 | 2 | Yes | 0 | 1 | 1 |
| SYM00095 | Ancient Landrace | 3167 | 0 | 0 | 1 | 1 | 2 | Yes | 0 | 1 | 1 |
| SYM00096 | Ancient Landrace | 3184 | 0 | 0 | 1 | 1 | 0 | No | 0 | 1 | 1 |

TABLE 31-continued (Summnary of in vitro characterization of bacterial endophytes isolated from ancestral seeds)

| Sym Strain ID | Source | SEQ ID NO: | Antagonize E. coli | Antagonize S. cerevisae | Shows Cellulolytic activity | Secretes siderophores | Phosphate Solubilization | Growth on Nitrogen Free LGI | ACC Deaminase Activity | Produces Auxin/ Indoles | Produces Acetoin |
|---|---|---|---|---|---|---|---|---|---|---|---|
| SYM00506 | Ancient Landrace | 3161 | 0 | 0 | 1 | 1 | 1 | No | 0 | 3 | 1 |
| SYM00018 | Ancient Landrace | 3235 | 0 | 0 | 0 | 0 | 0 | No | 0 | 2 | 0 |
| SYM00020 | Ancient Landrace | 3199 | 0 | 0 | 0 | 0 | 1 | Yes | 0 | 3 | 0 |
| SYM00506b | Ancient Landrace | 3145 | 0 | 1 | 1 | 1 | 1 | No | 0 | 3 | 3 |
| SYM00731A | Ancient Landrace | 3174 | 0 | 0 | 1 | 0 | 1 | No | 1 | 2 | 0 |
| SYM00049 | Ancient Landrace | 3116 | 0 | 0 | 0 | 1 | 0 | No | 0 | 3 | 1 |
| SYM00057 | Ancient Landrace | 3248 | 0 | 0 | 0 | 0 | 0 | No | 0 | 0 | 1 |
| SYM00058 | Ancient Landrace | 3220 | 0 | 0 | 0 | 0 | 0 | No | 0 | 0 | 3 |
| SYM00082a | Ancient Landrace | 3236 | 0 | 0 | 0 | 1 | 0 | Yes | 0 | 1 | 0 |
| SYM00101 | Ancient Landrace | 3221 | 0 | 0 | 0 | 1 | 0 | No | 0 | 2 | 0 |
| SYM00502 | Ancient Landrace | 3185 | 0 | 0 | 0 | 1 | 1 | No | 0 | 3 | 0 |
| SYM00511 | Ancient Landrace | 3222 | 0 | 0 | 0 | 0 | 0 | No | 0 | 2 | 1 |
| SYM00514b | Ancient Landrace | 3162 | 0 | 0 | 0 | 0 | 2 | No | 0 | 3 | 3 |
| SYM00514C | Ancient Landrace | 3200 | 0 | 0 | 0 | 0 | 0 | No | 3 | 0 | 1 |
| SYM00514D | Ancient Landrace | 3186 | 0 | 0 | 0 | 0 | 0 | No | 0 | 2 | 3 |
| SYM00100 | Ancient Landrace | 3157 | 1 | 1 | 1 | 1 | 1 | No | 0 | 3 | 0 |
| SYM00078 | Ancient Landrace | 3141 | 3 | 1 | 1 | 1 | 2 | Yes | 0 | 3 | 0 |
| SYM00544 | Ancient Landrace | 3187 | 0 | 1 | 0 | 0 | 1 | No | 0 | 3 | 0 |
| SYM00545B | Ancient Landrace | 3223 | 0 | 1 | 0 | 0 | 0 | No | 0 | 2 | 0 |
| SYM00548 | Ancient Landrace | 3201 | 0 | 1 | 0 | 0 | 1 | No | 0 | 2 | 0 |
| SYM00552 | Ancient Landrace | 3202 | 0 | 1 | 0 | 0 | 0 | No | 0 | 2 | 1 |
| SYM00558 | Ancient Landrace | 3203 | 0 | 1 | 0 | 0 | 1 | No | 0 | 2 | 0 |
| SYM00583 | Ancient Landrace | 3204 | 0 | 1 | 0 | 0 | 1 | No | 0 | 2 | 0 |
| SYM00584 | Ancient Landrace | 3224 | 0 | 0 | 0 | 0 | 1 | No | 0 | 2 | 0 |
| SYM00588 | Ancient Landrace | 3168 | 0 | 1 | 0 | 0 | 2 | No | 0 | 2 | 2 |
| SYM00596 | Ancient Landrace | 3114 | 0 | 1 | 0 | 0 | 1 | No | 0 | 2 | 3 |
| SYM00600 | Ancient Landrace | 3188 | 0 | 1 | 0 | 0 | 2 | No | 0 | 2 | 0 |
| SYM00746 | Ancient Landrace | 3175 | 1 | 1 | 0 | 0 | 1 | No | 1 | 1 | 1 |
| SYM00064a | Wild relative | 3142 | 0 | 0 | 0 | 0 | 0 | No | 0 | 1 | 0 |
| SYM00183 | Wild relative | 3176 | 0 | 0 | 0 | 0 | 0 | No | 0 | 1 | 2 |
| SYM00184 | Wild relative | 3205 | 0 | 0 | 0 | 0 | 0 | No | 0 | 1 | 3 |
| SYM00543 | Ancient Landrace | 3225 | 1 | 1 | 0 | 0 | 0 | No | 0 | 1 | 0 |
| SYM00595 | Ancient Landrace | 3118 | 1 | 1 | 0 | 0 | 0 | No | 0 | 1 | 0 |
| SYM00551 | Ancient Landrace | 3189 | 0 | 1 | 0 | 1 | 0 | No | 2 | 1 | 0 |
| SYM00547 | Ancient Landrace | 3129 | 0 | 0 | 0 | 2 | 0 | No | 1 | 1 | 0 |
| SYM00560 | Ancient Landrace | 3226 | 0 | 0 | 0 | 1 | 0 | No | 0 | 2 | 0 |
| SYM00586b | Ancient Landrace | 3190 | 0 | 1 | 0 | 2 | 0 | No | 0 | 2 | 0 |
| SYM00585 | Ancient Landrace | 3177 | 0 | 0 | 0 | 1 | 2 | No | 1 | 2 | 0 |
| SYM00824 | Ancient Landrace | 3192 | 0 | 1 | 0 | 0 | 0 | No | 3 | 1 | 0 |
| SYM00588b | Ancient Landrace | 3191 | 0 | 0 | 0 | 0 | 0 | No | 0 | 3 | 2 |
| SYM00591 | Ancient Landrace | 3206 | 0 | 0 | 0 | 0 | 0 | No | 3 | 1 | 0 |
| SYM00828 | Ancient Landrace | 3237 | 0 | 0 | 0 | 1 | 0 | No | 0 | 1 | 0 |
| SYM00830 | Ancient Landrace | 3207 | 0 | 0 | 0 | 0 | 0 | No | 3 | 1 | 0 |
| SYM00831 | Ancient Landrace | 3208 | 0 | 0 | 0 | 1 | 1 | No | 1 | 1 | 0 |
| SYM00052 | Wild relative | 3133 | 0 | 0 | 1 | 0 | 1 | No | 0 | 1 | 1 |
| SYM00053 | Wild relative | 3209 | 0 | 0 | 1 | 0 | 1 | No | 0 | 0 | 1 |
| SYM00054 | Wild relative | 3210 | 0 | 0 | 0 | 1 | 0 | No | 0 | 1 | 3 |
| SYM00028 | Ancient Landrace | 3115 | 1 | 1 | 1 | 0 | 1 | No | 0 | 1 | 3 |
| SYM00633 | Ancient Landrace | 3138 | 1 | 1 | 1 | 0 | 2 | No | 1 | 3 | 3 |
| SYM00538E | Ancient Landrace | 3158 | 1 | 1 | 0 | 2 | 1 | No | 3 | 1 | 0 |
| SYM00574 | Ancient Landrace | 3149 | 2 | 1 | 0 | 2 | 1 | No | 3 | 1 | 1 |
| SYM00501 | Ancient Landrace | 3146 | 3 | 1 | 0 | 2 | 0 | No | 3 | 2 | 0 |
| SYM00504 | Ancient Landrace | 3147 | 3 | 1 | 0 | 2 | 0 | No | 3 | 2 | 0 |
| SYM00536 | Ancient Landrace | 3148 | 3 | 1 | 0 | 3 | 1 | No | 1 | 2 | 0 |
| SYM00575 | Ancient Landrace | 3150 | 3 | 1 | 0 | 2 | 1 | No | 3 | 1 | 0 |
| SYM00542 | Ancient Landrace | 3214 | 0 | 0 | 1 | 0 | 0 | No | 0 | 1 | 1 |
| SYM00556 | Ancient Landrace | 3193 | 0 | 0 | 1 | 0 | 0 | No | 0 | 3 | 0 |
| SYM00586c | Ancient Landrace | 3178 | 0 | 0 | 1 | 0 | 0 | No | 0 | 2 | 2 |
| SYM00177 | Wild relative | 3211 | 0 | 0 | 0 | 0 | 0 | No | 0 | 1 | 3 |
| SYM00514A | Ancient Landrace | 3212 | 0 | 0 | 0 | 0 | 0 | No | 0 | 2 | 2 |
| SYM00523 | Wild relative | 3213 | 0 | 0 | 0 | 0 | 0 | No | 0 | 2 | 2 |
| SYM00538H | Ancient Landrace | 3238 | 0 | 0 | 0 | 0 | 0 | No | 0 | 0 | 2 |
| SYM00598 | Ancient Landrace | 3227 | 0 | 0 | 0 | 0 | 0 | No | 0 | 1 | 2 |
| SYM00051 | Wild relative | 3163 | 0 | 2 | 0 | 2 | 0 | No | 0 | 2 | 2 |
| SYM00587 | Ancient Landrace | 3169 | 0 | 0 | 2 | 0 | 0 | No | 0 | 2 | 1 |
| SYM00104 | Ancient Landrace | 3249 | 1 | 0 | 0 | 0 | 0 | Yes | 0 | 0 | 0 |
| SYM00832 | Ancient Landrace | 3239 | 1 | 0 | 0 | 0 | 0 | No | 0 | 0 | 1 |
| SYM00252 | Ancient Landrace | 3485 | 0 | 0 | 0 | 0 | 0 | Yes | 0 | 0 | 0 |
| SYM00182 | Ancient Landrace | 3151 | 1 | 0 | 1 | 0 | 1 | No | 1 | 3 | 3 |
| SYM00179 | Ancient Landrace | 3164 | 1 | 0 | 2 | 0 | 1 | No | 0 | 1 | 1 |
| SYM00021 | Wild relative | 3131 | 2 | 0 | 3 | 2 | 0 | No | 0 | 2 | 0 |
| SYM00589 | Ancient Landrace | 3126 | 0 | 0 | 0 | 0 | 0 | No | 0 | 3 | 2 |
| SYM00057B | Ancient Landrace | 3113 | 0 | 1 | 1 | 1 | 1 | Yes | 3 | 1 | 0 |

TABLE 31-continued (Summnary of in vitro characterization of bacterial endophytes isolated from ancestral seeds)

| Sym Strain ID | Source | SEQ ID NO: | Antagonize E. coli | Antagonize S. cerevisae | Shows Cellulolytic activity | Secretes siderophores | Phosphate Solubilization | Growth on Nitrogen Free LGI | ACC Deaminase Activity | Produces Auxin/ Indoles | Produces Acetoin |
|---|---|---|---|---|---|---|---|---|---|---|---|
| SYM00102 | Ancient Landrace | 3124 | 0 | 0 | 0 | 0 | 0 | No | 0 | 0 | 2 |
| SYM00553 | Ancient Landrace | 3240 | 0 | 1 | 0 | 0 | 0 | No | 0 | 0 | 1 |
| SYM00601 | Ancient Landrace | 3215 | 1 | 0 | 0 | 0 | 0 | No | 0 | 0 | 3 |
| SYM00507 | Ancient Landrace | 3179 | 2 | 1 | 0 | 0 | 0 | No | 0 | 2 | 1 |
| SYM00072 | Wild relative | 3194 | 2 | 0 | 0 | 0 | 0 | No | 0 | 0 | 3 |
| SYM00564 | Ancient Landrace | 3228 | 2 | 1 | 0 | 0 | 0 | No | 0 | 0 | 0 |
| SYM00075 | Wild relative | 3134 | 2 | 0 | 0 | 0 | 0 | No | 0 | 0 | 3 |
| SYM00562 | Ancient Landrace | 3241 | 2 | 0 | 0 | 0 | 0 | No | 0 | 0 | 0 |
| SYM00062b | Wild relative | 3180 | 0 | 0 | 1 | 0 | 0 | No | 0 | 3 | 1 |
| SYM00065 | Wild relative | 3250 | 0 | 0 | 0 | 0 | 0 | No | 0 | 0 | 1 |
| SYM00975 | Ancient Landrace | 3128 | 0 | 0 | 0 | 2 | 2 | No | 0 | 0 | 3 |
| SYM00545 | Ancient Landrace | 3229 | 0 | 1 | 0 | 0 | 0 | No | 0 | 2 | 0 |
| SYM00554 | Ancient Landrace | 3130 | 0 | 1 | 0 | 0 | 0 | No | 0 | 1 | 1 |
| SYM00555 | Ancient Landrace | 3252 | 0 | 1 | 0 | 0 | 0 | No | 0 | 0 | 0 |
| SYM00506c | Ancient Landrace | 3216 | 0 | 0 | 0 | 0 | 0 | No | 0 | 3 | 1 |
| SYM00506D | Ancient Landrace | 3242 | 0 | 0 | 0 | 0 | 0 | No | 0 | 2 | 0 |
| SYM00549 | Ancient Landrace | 3251 | 0 | 0 | 0 | 0 | 0 | No | 0 | 1 | 0 |
| SYM00012 | Wild relative | 3121 | 1 | 0 | 0 | 0 | 1 | No | 0 | 1 | 1 |
| SYM00050 | Ancient Landrace | 3153 | 0 | 2 | 1 | 1 | 1 | No | 0 | 2 | 2 |
| SYM00046 | Ancient Landrace | 3136 | 1 | 3 | 1 | 2 | 1 | No | 0 | 1 | 3 |
| SYM00106 | Ancient Landrace | 3243 | 0 | 0 | 1 | 0 | 0 | Yes | 0 | 0 | 0 |
| SYM00108 | Ancient Landrace | 3244 | 0 | 0 | 1 | 0 | 0 | Yes | 0 | 0 | 0 |
| SYM00107 | Ancient Landrace | 3125 | 0 | 0 | 0 | 0 | 0 | Yes | 0 | 0 | 1 |
| SYM00090 | Ancient Landrace | 3122 | 1 | 0 | 0 | 1 | 0 | No | 0 | 0 | 0 |
| SYM00002 | Wild relative | 3119 | 0 | 0 | 2 | 0 | 0 | No | 0 | 3 | 0 |
| SYM00060 | Ancient Landrace | 3137 | 0 | 0 | 0 | 0 | 0 | No | 0 | 0 | 3 |
| SYM00071 | Wild relative | 3120 | 0 | 0 | 0 | 0 | 0 | No | 0 | 0 | 2 |
| SYM00563 | Ancient Landrace | 3553 | 0 | 0 | 0 | 0 | 0 | No | 0 | 0 | 0 |
| SYM00617 | Wild relative | 3230 | 0 | 0 | 0 | 0 | 0 | No | 0 | 1 | 2 |
| SYM00960 | Ancient Landrace | 3195 | 0 | 0 | 0 | 2 | 0 | No | 0 | 0 | 3 |
| SYM00992 | Wild relative | 3152 | 0 | 0 | 0 | 0 | 2 | No | 0 | 0 | 2 |
| SYM00524 | Wild relative | 3217 | 0 | 0 | 0 | 0 | 0 | No | 0 | 1 | 3 |
| SYM00063 | Wild relative | 3170 | 1 | 0 | 0 | 0 | 0 | No | 0 | 1 | 3 |
| SYM00527 | Wild relative | 3171 | 0 | 0 | 1 | 0 | 1 | No | 0 | 3 | 1 |
| SYM00538A | Ancient Landrace | 3143 | 0 | 0 | 1 | 0 | 0 | No | 0 | 2 | 0 |
| SYM00508 | Ancient Landrace | 3135 | 0 | 0 | 1 | 0 | 1 | No | 0 | 2 | 0 |

Production of Auxin

Indole containing IAA is able to generate a pinkish chromophore under acidic conditions in the presence of ferric chloride. Microbial strains were inoculated into R2A both supplemented with L-TRP (5 mM) in 2 mL 96 well culture plates (1 mL). The plate was sealed with a breathable membrane and incubated at 23° C. under static conditions for 5 days. After 5 days, 150 µL of each culture was transferred to a 96 well plate and the OD600 measured. After measuring the OD600, the plate was centrifuged, and 50 µL of supernatant was transferred to a new 96 well plate, mixed with 100 µL of Salkowski reagent (1 mL of FeCl3 0.5 M solution to 50 mL of 35% HClO4) and incubated in the dark for 30 minutes and OD530 nm measured to detect the pink/red color.

Auxin is an important plant hormone, which can promote cell enlargement and inhibit branch development (meristem activity) in above ground plant tissues, while below ground it has the opposite effect, promoting root branching and growth. Interestingly, plant auxin is manufactured above ground and transported to the roots. It thus follows that plant and especially root inhabiting microbes which produce significant amounts of auxin will be able to promote root branching and development even under conditions where the plant reduces its own production of auxin. Such conditions can exist for example when soil is flooded and roots encounter an anoxic environment.

We screened seed derived bacteria for their ability to produce auxins as possible root growth promoting agents. A very large proportion of the bacteria tested, approximately 103 out of 140, or 73% of the total strains, showed a detectable level of pink or red colour development (the diagnostic feature of the assay suggesting auxin or indolic compound production). 63 strains (45% of total) had particularly strong production of auxin or indole compounds.

Mineral Phosphate Solubilization

Microbes were plated on tricalcium phosphate media as described in Rodriguez et al., (2001) J Biotechnol 84: 155-161 (incorporated herein by reference). This was prepared as follows: 10 g/L glucose, 0.373 g/L $NH_4NO_3$, 0.41 g/L $MgSO_4$, 0.295 g/L NaCl, 0.003 $FeCl_3$, 0.7 g/L $Ca_3HPO_4$, 100 mM Tris and 20 g/L Agar, pH 7, then autoclaved and poured into square Petri plates. After 3 days of growth at 28° C. in darkness, clear halos were measured around colonies able to solubilize the tricalcium phosphate.

Approximately 50 strains (36% of the strains), showed some ability to solubilize mineral phosphate, with 15 strains (11%) producing strong levels of mineral phosphate solubilization.

Growth on Nitrogen Free LGI Media

All glassware was cleaned with 6 M HCl before media preparation. A new 96 well plate (300 ul well volume) was filled with 250 ul/well of sterile LGI broth [per L, 50 g Sucrose, 0.01 g $FeCl_3$-$6H_2O$, 0.02 g $CaCl_2$, 0.8 g $K_3PO_4$, 0.2 g CaCl2, 0.2 g $MgSO_4$-$7H_2O$, 0.002 g $Na_2MoO_4$-$2H_2O$, pH 7.5]. Microbes were inoculated into the 96 wells simultaneously with a flame-sterilized 96 pin replicator. The plate was sealed with a breathable membrane, incubated at 28° C. without shaking for 3 days, and $OD_{600}$ readings taken with a 96 well plate reader.

A nitrogen fixing plant associated bacterium is able theoretically to add to the host's nitrogen metabolism, and the most famous beneficial plant associated bacteria, *rhizobia*, are able to do this within specially adapted organs leguminous plant grows for them to be able to do this. These seed associated bacteria may be able to fix nitrogen in association with the developing seedling, whether they colonize the plant's surfaces or interior and thereby add to the plant's nitrogen nutrition.

In total, of the 140 isolates there were 15 (10% of strains tested) which had detectable growth under nitrogen limiting conditions (Table 31).

ACC Deaminase Activity

Microbes were assayed for growth with ACC as their sole source of nitrogen. Prior to media preparation all glassware was cleaned with 6 M HCl. A 2 M filter sterilized solution of ACC (#1373A, Research Organics, USA) was prepared in water. 2 µl/mL of this was added to autoclaved LGI broth (see above), and 250 uL aliquots were placed in a brand new (clean) 96 well plate. The plate was inoculated with a 96 pin library replicator, sealed with a breathable membrane, incubated at 28° C. without 3 days, and OD600 readings taken. Only wells that were significantly more turbid than their corresponding nitrogen free LGI wells were considered to display ACC deaminase activity.

Plant stress reactions are strongly impacted by the plant's own production and overproduction of the gaseous hormone ethylene. Ethylene is metabolized from its precursor 1-aminocyclopropane-1-carboxylate (ACC) which can be diverted from ethylene metabolism by microbial and plant enzymes having ACC deaminase activity. As the name implies, ACC deaminase removes molecular nitrogen from the ethylene precursor, removing it as a substrate for production of the plant stress hormone and providing for the microbe a source of valuable nitrogen nutrition. It is somewhat surprising, but this microbially mediated biochemical ability to reduce plant stress is very important as damage to plant growth under various stress conditions is believed to result from over production of ethylene (Journal of Industrial Microbiology & Biotechnology, October 2007, Volume 34, Issue 10, pp 635-648).

In total, of the 140 isolates there were 28 strains (20%) which had greater growth on nitrogen free LGI media supplemented with ACC, than in nitrogen free LGI. Of these, 14 strains (10%) had very high ACC deaminase activity.

Acetoin and Diacetyl Production

The method was adapted from Phalip et al., (1994) J Basic Microbiol 34: 277-280. (incorporated herein by reference). 250 ml of autoclaved R2A broth supplemented with 0.5% glucose was aliquoted into a 96 well plate (#07-200-700, Fisher). The microbial endophytes from a glycerol stock plate were inoculated using a flame-sterilized 96 pin replicator, sealed with a breathable membrane, then incubated for 3 days without shaking at 28° C. At day 3, 50 µl/well was added of freshly blended Barritt's Reagents A and B [5 g/L creatine mixed 3:1 (v/v) with freshly prepared $\alpha$-naphthol (75 g/L in 2.5 M sodium hydroxide)]. After 15 minutes, plates were scored for red or pink colouration relative to a copper coloured negative control (measured as 525 nm absorption on a plate reader).

A very high proportion of the stains tested were found to produce acetoin: 76 strains of the 140 tested, or 54%, produced at least some detectable level of acetoin, with 40 strains (28%) producing moderate to high levels (Table 31).

Siderophore Production

To ensure no contaminating iron was carried over from previous experiments, all glassware was deferrated with 6 M HCl and water prior to media preparation [Cox (1994) Methods Enzymol 235: 315-329, incorporated herein by reference]. In this cleaned glassware, R2A broth media, which is iron limited, was prepared and poured (250 ul/well) into 96 well plates and the plate then inoculated with microbes using a 96 pin plate replicator. After 3 days of incubation at 28° C. without shaking, to each well was added 100 ul of O-CAS preparation without gelling agent [Perez-Miranda et al. (2007), J Microbiol Methods 70: 127-131, incorporated herein by reference]. Again using the cleaned glassware, 1 liter of O-CAS overlay was made by mixing 60.5 mg of Chrome azurol S (CAS), 72.9 mg of hexadecyltrimethyl ammonium bromide (HDTMA), 30.24 g of finely crushed Piperazine-1,4-bis-2-ethanesulfonic acid (PIPES) with 10 ml of 1 mM $FeCl_3.6H_2O$ in 10 mM HCl solvent. The PIPES had to be finely powdered and mixed gently with stirring (not shaking) to avoid producing bubbles, until a dark blue colour was achieved. 15 minutes after adding the reagent to each well, colour change was scored by looking for purple halos (catechol type siderophores) or orange colonies (hydroxamate siderophores) relative to the deep blue of the O-Cas.

In many environments, iron is a limiting nutrient for growth. A coping mechanism which many microbes have developed is to produce and secrete iron chelating compounds called siderophores which often only that particular species or strain has the means to re-uptake and interact with to release the bound iron, making it available for metabolism. A fringe effect of siderophore production and secretion is that a siderophore secreting microbes can remove all the bioavailable iron in its environment, making it difficult for a competing species to invade and grow in that micro-environment.

Siderophore production by microbes on a plant surface or inside a plant may both show that a microbe is equipped to grow in a nutrient limited environment, and perhaps protect the plant environment from invasion by other, perhaps undesirable microbes. Siderophore production was detectable in 45 strains (32%), with 18 strains producing significant amounts.

Cellulase Activity

Iodine reacts with cellulose to form a dark blue-colored complex, leaving clear halos as evidence of extracellular enzyme activity. Adapting a previous protocol [Kasana et al. (2008), Curr Microbiol 57: 503-507, incorporated herein by reference] 0.2% carboxymethylcellulose (CMC) sodium salt (#C5678, Sigma) and 0.1% triton X-100 were added to R2A media, autoclaved and poured into 150 mm plates. Microbes were inoculated using a 96 pin plate replicator. After 3 days of culturing in the darkness at 25° C., cellulose activity was visualized by flooding the plate with Gram's iodine. Positive colonies were surrounded by clear halos. 47 strains, or approximately 33%, were found to produce cellulase activity. Interestingly, 11 strains produced high levels of cellulase activity (Table 31).

Antibiosis

Production of antimicrobial compounds from endophytes was tested essentially as described in Johnston-Monje et al., (2012) PLoS ONE 6(6): e20396, which is incorporated herein by reference. Briefly, colonies of either *E. coli* DH5$\alpha$ (gram negative tester), *Bacillus subtillus* ssp. *subtilis* (gram positive tester), or yeast strain *Saccharomyces cerevisiae* AH109 (fungal tester) were resuspended in 1 mL LB to an OD600 of 0.2, and 30 µL of this was mixed with 30 mL of warm LB agar. Serial dilutions were made and plates poured. Microbes were inoculated onto rectangular plates containing R2A agar using a 96 pin plate replicator, incubated for one day at 28 C and one day at 23 C. Antibiosis was scored by observing clear halos around endophyte colonies. 30 strains were found to produce *E. coli*-antagonistic activity, while 39 strains had activity against *S. cerevisiae*.

Example 5

Testing of Ancestral Seed-Origin Bacterial Endophyte Populations on Plants

Experimental Aim

The results shown above demonstrate that many of the endophytic bacteria derived from ancestral relatives of modern agricultural plants possess activities that could impart beneficial traits to a plant upon colonization. First, many of the bacteria described here are capable of producing compounds that could be beneficial to the plant, as detected using the in vitro assays described above. In addition, several representative bacteria were tested and found to successfully colonize corn plants as demonstrated in the example above. The aim of the experiments in this section addresses the ability of the bacterial endophytes to confer beneficial traits on a host plant. Several different methods were used to ascertain this. First, plants inoculated with bacteria were tested under conditions without any stress to determine whether the microbe confers an increase in vigor. Second, endophyte-inoculated plants were tested under specific stress conditions (e.g., salt stress, heat stress, water stress, and combinations thereof) to test whether the bacteria confer an increase in tolerance to these stresses. These growth tests were performed using two different means: using growth assays on water-agar plates, and using growth assays on sterile filter papers.

Experimental Description
Surface Sterilization of Seeds

Un-treated maize seeds and wheat seeds were sterilized overnight with chlorine gas as follows: 200 g of seeds were weighed and placed in a 250 mL glass bottle. The opened bottle and its cap were placed in a dessicator jar in a fume hood. A beaker containing 100 mL of commercial bleach (8.25% sodium hypochlorite) was placed in the dessicator jar. Immediately prior to sealing the jar, 3 mL of concentrated hydrochloric acid (34-37.5%) were carefully added to the bleach. The sterilization was left to proceed for 18-24 h. After sterilization, the bottle was closed with its sterilized cap, and reopened in a sterile flow hood. The opened bottle was left in the sterile hood for a couple hours to air out the seeds and remove chlorine gas leftover. The bottle was then closed and the seeds stored at room temperature in the dark until use.

Water Agar Assays

Bacterial endophytes isolated from seeds as described herein were tested for their ability to promote plant growth under normal and stressed conditions by inoculating maize and wheat seeds with those endophytes and germinating them on water agar. For each bacterial endophyte tested, 5 mL of liquid R2A medium was inoculated with a single colony and the culture grown at room temperature on a shaker to an OD (600 nm) of between 0.8 and 1.2.

Sterilized maize and wheat seeds were placed on water agar plates (1.3% bacto agar) in a laminar flow hood, using forceps previously flamed. A drop of inoculum with an OD comprised between 0.8 and 1.2 (corresponding to about $10^8$ CFU/mL) was placed on each seed (50 uL for maize, 30 uL for wheat, representing approximately $5.10^6$ and $3.10^6$ CFUs for maize and wheat, respectively). For each treatment, 3 plates were prepared with 12 seeds each. Plates were sealed with surgical tape, randomized to avoid position effects and placed in a growth chamber set at 22° C., 60% relative humidity, in the dark for four days. After four days, a picture of each plate was taken and the root length of each seedling was measured using the imaging software ImageJ. The percentage difference between the treated plants and the mock-treated (R2A control) was then calculated. For growth under salt stress, the water agar plates were supplemented with 100 mM NaCl. For growth under heat stress, the plates were placed at 40° C., 60% humidity after two days of growth, and left for an additional two days.

Filter Paper Growth Assay

Filter papers were autoclaved and placed into Petri dishes, and then presoaked with treatment solutions. To simulate normal conditions, 3-4 mL sterile water was added to the filters. Water and saline stresses were induced by adding 3-4 mL 8% PEG 6000 solution or 50 or 100 mM NaCl to the filter papers. Surface sterilized seeds were incubated in bacterial inocula for at least one hour prior to plating. Nine seeds were plated in triplicate for each condition tested, including room temperature and heat stress (40° C.) for both normal and saline conditions. During initial stages of the experiment, plates were sealed with parafilm to inhibit evaporative water loss and premature drying of the filter papers. Plates were incubated in the dark at room temperature for two days following which heat treatment plates were shifted to 40° C. for 4-6 days. Parafilm was removed from all plates after 3-5 days. After 5-8 days, seedlings were scored by manually measuring root length for corn and shoot length for wheat and recording the mass of pooled seedlings from individual replicates.

Experimental Results

Plant vigor and improved stress resilience are important components of providing fitness to a plant in an agricultural setting. These can be measured in germination assays to test the improvement on the plant phenotype as conferred by microbial inoculation. The collection of seed-derived endophytes produced a measurable response in corn and wheat when inoculated as compared to non-inoculated controls, as shown in Tables 32A-32D. For example, most of the strains tested were found to produce a favorable phenotype in any of the measured multiple parameters such as root length, weight, or shoot length in wheat, suggesting that the strains play an intimate role modulating and improving plant vigor and conferring stress resilience to the host plant. In wheat under normal conditions (vigor), 78% of the strains tested showed some level of effect and 63% a strong plant response suggesting the physiology and ecological niches of the strain collection can be associated to a beneficial plant role. The stress responses in the strain collection can be seen by the ability of a subgroup to confer a beneficial response under different conditions such as heat and salt and water stress. These can be applicable to products for arid and marginal lands. In a large proportion of cases for the tested strains, the beneficial effect was measurable in both crops indicating that the strains are capable of colonizing multiple varieties and plant species. This can play a role in their mechanisms for dispersal and colonization from one seed into a mature plant but also as part of the life cycle to establish an ample distribution range and ecological persistence in nature.

TABLE 32A (ancestral seed-origin bacterial endophyte populations on plants in corn assays)

| Strain | Source | Old OTU# | NEW OTU# | Weight Corn Variety 1 | Root length Corn Variety 2 | Root length Corn-variety 3 water-agar Normal | Root length Corn-variety 3 water-agar Salt |
|---|---|---|---|---|---|---|---|
| SYM00002 | Wild relative | 66 | 3119 | N/A | N/A | 2 | 2 |
| SYM00011 | Wild relative | 2 | 3123 | N/A | N/A | — | 1 |
| SYM00012 | Wild relative | 55 | 3121 | N/A | N/A | 2 | 2 |
| SYM00028 | Ancient Landrace | 18 | 3115 | N/A | N/A | 2 | N/A |
| SYM00049 | Ancient Landrace | 7 | 3116 | 2 | 1 | 3 | 1 |
| SYM00052 | Wild relative | 18 | 3133 | N/A | N/A | 1 | — |
| SYM00057b | Ancient Landrace | 37 | 3113 | N/A | N/A | 3 | 2 |
| SYM00060 | Ancient Landrace | 67 | 3137 | N/A | N/A | 1 | N/A |
| SYM00064a | Wild relative | 10 | 3142 | N/A | N/A | 2 | 2 |
| SYM00071 | Wild relative | 76 | 3120 | N/A | N/A | 1 | |
| SYM00090 | Ancient Landrace | 62 | 3122 | N/A | N/A | — | 1 |

TABLE 32B (Root length and weight of ancestral seed-origin bacterial endophyte populations on plants)

| Strain | Root length Normal | Root length Heat | Root length Salt | Root length Heat-salt | Root length Water stress | Weight Normal | Weight Heat | Weight Salt | Weight Heat-salt | Weight Water stress |
|---|---|---|---|---|---|---|---|---|---|---|
| SYM00002 | 1 | 3 | — | — | 3 | 2 | 3 | 1 | — | 1 |
| SYM00011 | N/A | N/A | N/A | N/A | 2 | — | — | — | — | 2 |
| SYM00012 | — | 1 | — | — | — | 2 | 2 | — | 2 | — |
| SYM00021 | — | — | 3 | 1 | — | — | — | — | — | — |
| SYM00028 | — | — | — | — | 3 | 1 | — | 2 | 3 | — |
| SYM00033 | — | 1 | 3 | 2 | 2 | 1 | 3 | — | 2 | — |
| SYM00049 | 1 | 3 | 1 | 2 | 1 | — | — | — | 1 | — |
| SYM00052 | N/A | N/A | N/A | N/A | 2 | — | — | — | — | 1 |
| SYM00057b | 1 | 1 | — | 1 | 1 | 1 | 3 | 1 | 1 | 1 |
| SYM00060 | 3 | 2 | 1 | — | — | — | 2 | — | — | — |
| SYM00063 | — | — | — | — | — | 1 | — | — | — | — |
| SYM00071 | — | 1 | 2 | 3 | — | 2 | 1 | 2 | 3 | — |
| SYM00075 | N/A | N/A | N/A | N/A | — | — | — | — | — | 3 |
| SYM00090 | 2 | 2 | 2 | — | 1 | 3 | 3 | 1 | 1 | — |
| SYM00102 | — | 2 | 3 | 3 | — | — | 1 | — | 3 | — |
| SYM00107 | — | 1 | — | — | — | 1 | — | — | 3 | 1 |
| SYM00508 | — | — | — | — | — | 1 | — | — | — | — |
| SYM00538A | 1 | 1 | 3 | — | — | — | — | — | 1 | — |
| SYM00547 | 2 | 1 | 3 | — | 1 | 1 | — | — | — | 1 |
| SYM00554 | — | 3 | — | 3 | — | — | 2 | — | 3 | — |
| SYM00589 | — | 2 | 3 | 3 | — | 1 | 3 | 1 | 3 | — |
| SYM00595 | 1 | 3 | 2 | 2 | — | 1 | 3 | 1 | 3 | — |
| SYM00596 | 1 | 3 | 3 | 3 | 1 | — | 3 | — | 3 | — |
| SYM00660 | — | 2 | 1 | 1 | 2 | — | 2 | — | — | 2 |
| SYM00967 | — | — | 3 | — | 3 | 1 | 1 | 1 | — | 1 |
| SYM00975 | 2 | — | 3 | — | 3 | 1 | 1 | — | — | 2 |
| SYM00992 | 1 | — | — | — | 3 | — | — | — | — | — |

TABLE 32C (Root length in normal, heat, and salt stress modes)

| Strain | Root Length Normal | Root Length Heat | Root Length Salt |
|---|---|---|---|
| SYM00028 | 3 | — | 2 |
| SYM00046 | 3 | N/A | N/A |
| SYM00049 | 3 | 2 | 2 |
| SYM00057b | 3 | 3 | 3 |
| SYM00060 | 2 | N/A | N/A |
| SYM00090 | 3 | 2 | 1 |

TABLE 32C-continued (Root length in normal, heat, and salt stress modes)

| Strain | Normal | Heat | Salt |
|---|---|---|---|
| SYM00102 | 2 | — | — |
| SYM00107 | 2 | 3 | — |
| SYM00508 | 3 | 3 | 1 |
| SYM00538A | 1 | — | 1 |
| SYM00547 | 2 | 3 | 2 |
| SYM00589 | — | 3 | 1 |
| SYM00595 | — | 3 | — |
| SYM00596 | 1 | 3 | 1 |
| SYM00965 | 2 | — | 1 |
| SYM00967 | 2 | 3 | 3 |
| SYM00975 | 1 | — | 2 |
| SYM00002 | 3 | — | 3 |
| SYM00011 | 3 | 3 | 3 |
| SYM00012 | 3 | 1 | 3 |
| SYM00021 | 3 | — | — |
| SYM00033 | 3 | — | 3 |
| SYM00052 | 1 | — | 3 |
| SYM00063 | 1 | — | — |
| SYM00064a | 3 | — | — |
| SYM00071 | 3 | — | — |
| SYM00075 | 3 | — | — |
| SYM00183 | 3 | — | — |
| SYM00660 | — | — | 2 |
| SYM00992 | — | — | 3 |

TABLE 32D (Root length and weight in normal, salt, and water stresses)

| | Shoot length | | | Weight | | |
|---|---|---|---|---|---|---|
| Strain | Normal | Salt | Water stress | Normal | Salt | Water stress |
| SYM00002 | — | 1 | — | — | 2 | — |
| SYM00011 | 3 | 1 | 3 | 3 | — | 2 |
| SYM00012 | — | 2 | 3 | 2 | — | 1 |
| SYM00028 | — | 3 | 3 | — | 3 | 3 |
| SYM00033 | 3 | 1 | 2 | — | — | 1 |
| SYM00049 | 3 | — | 3 | 2 | — | 2 |
| SYM00052 | 1 | — | 1 | 3 | — | — |
| SYM00057b | 3 | 3 | 1 | 2 | — | 3 |
| SYM00064a | — | 2 | 2 | — | — | — |
| SYM00071 | 2 | 3 | 3 | — | 3 | 1 |
| SYM00075 | — | 1 | 3 | — | — | 3 |
| SYM00090 | — | — | 3 | — | — | 3 |
| SYM00102 | — | 3 | 3 | 2 | 3 | — |
| SYM00107 | 1 | 3 | 3 | 2 | 3 | 3 |
| SYM00508 | — | 3 | — | — | 2 | — |
| SYM00547 | N/A | N/A | 1 | N/A | N/A | — |
| SYM00554 | — | 3 | — | — | 3 | — |
| SYM00595 | 1 | 3 | 3 | 2 | 3 | — |
| SYM00596 | 1 | 3 | 3 | 1 | 3 | 2 |
| SYM00660 | N/A | N/A | 3 | N/A | N/A | — |

Example 6

Identification and Characterization of Culturable Bacterial and Fungal Endophytes Belonging to OTUs Present in Landrace and Wild Corn and Wheat Seeds that have been Lost in Modern Corn and Wheat Seeds Isolation and Identification of Culturable Microbes In order to better understand the role played by landrace and wild seed-derived endophytic microbes in improving the vigor, general health and stress resilience of modern agricultural plants, we identified culturable microbes that belong to the same OTUs as certain microbes of Tables 16-23 that were present in landrace and wild seeds but were present at much lower levels in modern wheat or corn. Using the same methods as in Example 3 and other techniques known in the art, bacterial endophytes were cultured from a variety of plant parts and a variety of plants. To accurately characterize the isolated microbial endophytes, colonies were submitted for marker gene sequencing, and the sequences were analyzed to provide taxonomic classifications. Among the cultured microbes, those with at least 97% 16S or ITS sequence similarity to certain microbes of Tables 16-19 were identified. Those microbes are listed in Table 33A.

TABLE 33A

Cultured bacterial isolates belonging to the same OTUs as certain bacteria of Tables 16-19 that were present in landrace and wild seeds but were present at much lower levels in modern wheat or corn.

| Cultured bacterial isolate | SEQ ID NO of cultured bacterial isolate | New SEQ ID NO of bacterial taxa from wild or landrace seed | Old OTU of bacterial taxa from wild or landrace seed | NEW OTU of bacterial taxa from wild or landrace seed |
|---|---|---|---|---|
| SYM00013 | 3590 | 33 | OTU_7 | B0.9|GG99|4327501 |
| SYM00018 | 3592 | 30, 31 | OTU_2, OTU_3489 | B0.9|GG99|9943, B0.9|GG97|2582263 |
| SYM00021b | 3594 | 27 | OTU_35 | B0.9|GG99|370327 |
| SYM00025 | 3595 | 30, 31 | OTU_2, OTU_3489 | B0.9|GG99|9943, B0.9|GG97|2582263 |
| SYM00028 | | 27 | OTU_35 | B0.9|GG99|370327 |
| SYM00043 | 3598 | 30, 31 | OTU_2, OTU_3489 | B0.9|GG99|9943, B0.9|GG97|2582263 |
| SYM00044 | 3599 | 27 | OTU_35 | B0.9|GG99|370327 |
| SYM00050 | 3600 | 26, 28, 24, 25, 1939, 1548 | OTU_3592, OTU_1384, OTU_3629, OTU_2970, OTU_3153, OTU_115 | B0.9|GG97|816702, B0.9|GG99|218527, B0.9|GG97|639627, B0.9|GG97|253061, B0.9|GG97|4374146, B0.9|GG99|625742 |

TABLE 33A-continued

Cultured bacterial isolates belonging to the same OTUs as certain bacteria of Tables 16-19 that were present in landrace and wild seeds but were present at much lower levels in modern wheat or corn.

| Cultured bacterial isolate | SEQ ID NO of cultured bacterial isolate | New SEQ ID NO of bacterial taxa from wild or landrace seed | Old OTU of bacterial taxa from wild or landrace seed | NEW OTU of bacterial taxa from wild or landrace seed |
|---|---|---|---|---|
| SYM00068 | 3606 | 33 | OTU_7 | B0.9\|GG99\|4327501 |
| SYM00074 | 3608 | 26, 28, 24, 25, 1939, 1548 | OTU_3592, OTU_1384, OTU_3629, OTU_2970, OTU_3153, OTU_115 | B0.9\|GG97\|816702, B0.9\|GG99\|218527, B0.9\|GG97\|639627, B0.9\|GG97\|253061, B0.9\|GG97\|4374146, B0.9\|GG99\|625742 |
| SYM00183 | 3620 | 37 | OTU_83 | B0.9\|GG99\|4102407 |
| SYM00184 | 3621 | 37 | OTU_83 | B0.9\|GG99\|4102407 |
| SYM00219 | 3624 | 18 | OTU_38 | B0.9\|GG99\|29974 |
| SYM00506c | 3629 | 16 | OTU_24 | B0.9\|GG99\|4294649 |
| SYM00508 | 3631 | 25 | OTU_2970 | B0.9\|GG97\|253061 |
| SYM00545 | 3637 | 16 | OTU_24 | B0.9\|GG99\|4294649 |
| SYM00549 | 3638 | 16 | OTU_24 | B0.9\|GG99\|4294649 |
| SYM00617 | 3645 | 18 | OTU_38 | B0.9\|GG99\|29974 |
| SYM00620 | 3646 | 26, 28, 24, 25, 1939, 1548 | OTU_3592, OTU_1384, OTU_3629, OTU_2970, OTU_3153, OTU_115 | B0.9\|GG97\|816702, B0.9\|GG99\|218527, B0.9\|GG97\|639627, B0.9\|GG97\|253061, B0.9\|GG97\|4374146, B0.9\|GG99\|625742 |
| SYM00646 | 3651 | 33 | OTU_7 | B0.9\|GG99\|4327501 |
| SYM00662 | 3653 | 2005 | OTU_11 | B0.9\|GG99\|560886 |
| SYM00905 | 3663 | 37 | OTU_83 | B0.9\|GG99\|4102407 |

Characterization of Culturable Microbes: Auxin, Acetoin and Siderophore Production The culturable microbes belonging to the same OTUs as certain microbes of Tables 16-23 that were present in landrace and wild seeds but were present at much lower levels in modern wheat or corn were then seeded onto 96 well plants and tested for auxin, acetoin and siderophore production, using the methods described in Example 5 with minor modifications. For auxin measurement, 1 µl of overnight-grown cultures of endophytic bacterial strains were inoculated into 750 µl of R2A broth supplemented with L-TRP (5 mM) in 2-mL 96 well culture plates. The plates were sealed with a breathable membrane and incubated at 23° C. with constant shaking at 200 rpm for 4 days. To measure anxin production by fungal strains, 3 µl of 5-day old liquid fungal cultures were inoculated into 1 ml R2A broth supplemented with L-TRP (5 mM) in 24-well culture plates. The plates were sealed with breathable tape and incubated at 23° C. with constant shaking at 130 rpm for 4 days. After 4 days, 100 µL of each culture was transferred to a 96 well plate. 25 µL of Salkowski reagent (1 mL of FeCl3 0.5 M solution to 50 mL of 35% HClO4) was added into each well and the plates were incubated in the dark for 30 minutes before taking picture and measuring 540 nm absorption using the SpectraMax M5 plate reader (Molecular Devices). For acetoin measurements, microbial strains were cultured as described above in R2A broth supplemented with 5% glucose. After 4 days, 100 µL of each culture was transferred to a 96 well plate and mixed with 25 µL Barritt's Reagents (See Example 4) and 525 nm absorption was measured. For siderophore measurements, microbial strains were cultured as described above in R2A broth. The results are presented in Tables 31A.

TABLE 33B

Auxin, siderophore, and acetoin production by culturable bacteria belonging to OTUs present in landrace and wild corn and wheat seeds that are present in lower levels in modern corn and wheat seeds

| Strain | SEQ ID NO. | Secretes siderophores | Produces Auxin/Indoles | Produces Acetoin |
|---|---|---|---|---|
| SYM00013 | 3590 | 0 | 1 | 0 |
| SYM00018 | 3592 | 0 | 3 | 2 |
| SYM00021b | 3594 | 0 | 2 | 3 |
| SYM00025 | 3595 | 1 | 3 | 2 |
| SYM00043 | 3598 | 1 | 3 | 2 |
| SYM00044 | 3599 | 1 | 1 | 3 |
| SYM00050 | 3600 | 1 | 2 | 3 |
| SYM00068 | 3606 | 2 | 2 | 0 |
| SYM00074 | 3608 | 2 | 3 | 0 |
| SYM00183 | 3620 | 0 | 2 | 1 |
| SYM00184 | 3621 | 0 | 2 | 0 |
| SYM00219 | 3624 | 3 | 2 | 3 |
| SYM00506c | 3629 | 0 | 2 | 2 |
| SYM00508 | 3631 | 0 | 3 | 2 |
| SYM00545 | 3637 | 2 | 2 | 2 |
| SYM00549 | 3638 | 2 | 2 | 2 |
| SYM00617 | 3645 | 1 | 3 | 1 |
| SYM00620 | 3646 | 1 | 3 | 0 |
| SYM00646 | 3651 | 3 | 2 | 3 |
| SYM00662 | 3653 | 1 | 1 | 1 |
| SYM00905 | 3663 | 3 | 2 | 2 |

In total, a very large proportion of the bacteria strains, 18 out of 21 strains tested, were able to utilize Tryptophan supplemented in the medium and showed a detectable level of pink or red color development (the diagnostic feature of the assay suggesting auxin or indolic compound production). 7 strains (33% of total) had particularly strong production of auxin or indole compounds. As for acetoin production, 13 out of 21 strains tested showed a detectable level of pink or red color (a proxy of acetoin production). Particularly, 5 of these 13 strains had strong production of acetoin. 7 out of 21 strains tested showed a detectable level of siderophore accumulation. Among these 7 strains, 3 strains showed very strong accumulation of siderophore.

Characterization of Culturable Microbes: Substrate Use

In addition to determining whether the strains produce auxin, acetoin, and siderophores, the ability of these strains to grow on a variety of substrates was determined. Liquid cultures of microbe were first sonicated to achieve homogeneity. 1 mL culture of each strain was harvested by centrifugation for 10 minutes at 4500 RPM and subsequently washed three times with sterile distilled water to remove any traces of residual media. Microbial samples were resuspended in sterile distilled water to a final $OD_{590}$ of 0.2. Measurements of absorbance were taken using a SpectraMax M microplate reader (Molecular Devices, Sunnyvale, Calif.).

Sole carbon substrate assays were done using BIOLOG Phenotype MicroArray (PM) 1 and 2A MicroPlates (Hayward, Calif.). An aliquot of each bacterial cell culture (2.32 mL) were inoculated into 20 mL sterile IF-0a GN/GP Base inoculating fluid (IF-0), 0.24 mL 100× Dye F obtained from BIOLOG, and brought to a final volume of 24 mL with sterile distilled water. Negative control PM1 and PM2A assays were also made similarly minus bacterial cells to detect abiotic reactions. An aliquot of fungal culture (0.05 mL) of each strain were inoculated into 23.95 mL FF-IF medium obtained from BIOLOG. Microbial cell suspensions were stirred in order to achieve uniformity. One hundred microliters of the microbial cell suspension was added per well using a multichannel pipettor to the 96-well BIOLOG PM1 and PM2A MicroPlates that each contained 95 carbon sources and one water-only (negative control) well.

MicroPlates were sealed in paper surgical tape (Dynarex, Orangeburg, N.Y.) to prevent plate edge effects, and incubated stationary at 24° C. in an enclosed container for 70 hours. Absorbance at 590 nm was measured for all MicroPlates at the end of the incubation period to determine carbon substrate utilization for each strain and normalized relative to the negative control (water only) well of each plate (Garland and Mills, 1991; Barua et al., 2010; Siemens et al., 2012; Blumenstein et al., 2015). The bacterial assays were also calibrated against the negative control (no cells) PM1 and PM2A MicroPlates data to correct for any biases introduced by media on the colorimetric analysis (Borglin et al., 2012). Corrected absorbance values that were negative were considered as zero for subsequent analysis (Garland and Mills, 1991; Blumenstein et al., 2015) and a threshold value of 0.1 and above was used to indicate the ability of a particular microbial strain to use a given carbon substrate (Barua et al., 2010; Blumenstein et al., 2015). Additionally, bacterial MicroPlates were visually examined for the irreversible formation of violet color in wells indicating the reduction of the tetrazolium redox dye to formazan that result from cell respiration (Garland and Mills, 1991). Fungal PM tests were measured as growth assays and visual observation of mycelial growth in each well was made.

The results of these assays are shown in Tables 31B (BIOLOG PM1 MicroPlates) and 31C (BIOLOG PM2A MicroPlates).

TABLE 33C

Substrate utilization as determined by BIOLOG PM1 MicroPlates by culturable bacteria belonging to OTUs present in landrace and wild corn and wheat seeds that are present in lower levels in modern corn and wheat seeds.

| Strain/Substrate | SYM13 | SYM18 | SYM183 | SYM184 | SYM219 | SYM43 | SYM50 | SYM508 | SYM617 | SYM620 | SYM68 | SYM905 |
|---|---|---|---|---|---|---|---|---|---|---|---|---|
| D-Serine | NO | NO | NO | NO | NO | NO | YES | NO | NO | NO | NO | NO |
| D-Glucose-6-Phosphate | NO | NO | NO | NO | NO | YES | YES | YES | NO | YES | NO | NO |
| L-Asparagine | NO | NO | NO | NO | NO | NO | NO | NO | NO | NO | NO | NO |
| L-glutamine | NO | NO | NO | NO | NO | NO | NO | NO | NO | NO | NO | NO |
| Glycyl-L-Aspartic acid | YES | NO | NO | NO | NO | YES | YES | NO | NO | NO | NO | NO |
| Glycyl-L-Glutamic acid | NO | NO | YES | YES | NO | NO | NO | NO | NO | NO | YES | NO |
| Glycyl-L-Proline | NO | NO | YES | YES | NO | NO | YES | NO | NO | NO | YES | YES |
| L-Arabinose | YES | YES | NO | YES | NO | YES | YES | NO | NO | NO | YES | NO |
| D-Sorbitol | NO | NO | NO | YES | NO | NO | YES | NO | NO | NO | NO | NO |
| D-Galactonic acid-?-lactone | YES | YES | NO | NO | YES | YES | NO | NO | NO | NO | NO | NO |
| D-Aspartic acid | NO | NO | NO | NO | NO | NO | NO | NO | NO | NO | NO | NO |
| m-Tartaric acid | YES | YES | NO | NO | NO | YES | NO | NO | NO | NO | NO | NO |
| Citric acid | NO | NO | NO | NO | NO | NO | NO | NO | NO | NO | YES | NO |
| Tricarballylic acid | NO | NO | NO | NO | NO | NO | NO | NO | NO | NO | NO | NO |
| p-Hydroxy Phenyl acetic acid | NO | NO | NO | NO | NO | NO | YES | NO | NO | NO | NO | NO |
| N-Acetyl-D-Glucosamine | YES | YES | YES | YES | YES | YES | YES | NO | NO | NO | NO | NO |
| Glycerol | NO | NO | NO | NO | NO | YES | YES | NO | NO | NO | NO | NO |
| D-L-Malic acid | NO | NO | NO | YES | NO | YES | NO | YES | YES | NO | YES | NO |
| D-Glucosaminic acid | NO | YES | NO | NO | NO | YES | NO | YES | NO | NO | NO | NO |
| D-Glucose-1-Phosphate | NO | YES | NO | NO | NO | YES | YES | YES | NO | NO | NO | NO |
| m-Inositol | NO | YES | NO | YES | NO | YES | YES | NO | NO | NO | NO | NO |
| L-Serine | NO | NO | NO | NO | NO | NO | NO | NO | NO | NO | NO | NO |
| m-Hydroxy Phenyl Acetic acid | NO | NO | NO | NO | NO | NO | YES | NO | YES | NO | NO | NO |

TABLE 33C-continued

Substrate utilization as determined by BIOLOG PM1 MicroPlates by culturable bacteria belonging to OTUs present in landrace and wild corn and wheat seeds that are present in lower levels in modern corn and wheat seeds.

| Strain/Substrate | SYM13 | SYM18 | SYM183 | SYM184 | SYM219 | SYM43 | SYM50 | SYM508 | SYM617 | SYM620 | SYM68 | SYM905 |
|---|---|---|---|---|---|---|---|---|---|---|---|---|
| D-Saccharic acid | NO | NO | NO | YES | NO | YES | YES | YES | NO | NO | NO | NO |
| L-Fucose | NO | NO | NO | NO | NO | NO | NO | NO | NO | NO | NO | NO |
| D-Ribose | NO | YES | YES | YES | NO | YES | NO | NO | NO | NO | YES | NO |
| 1,2-Propanediol | NO | NO | NO | NO | NO | NO | NO | NO | NO | NO | NO | NO |
| D-Fructose-6-Phosphate | NO | YES | NO | NO | NO | NO | YES | YES | NO | YES | NO | NO |
| D-Threonine | NO | NO | NO | NO | NO | NO | NO | NO | NO | NO | NO | NO |
| L-Threonine | NO | NO | NO | NO | NO | NO | NO | NO | NO | NO | NO | NO |
| Tyramine | YES | YES | YES | NO | YES | NO | NO | NO | NO | NO | YES | NO |
| Succinic acid | NO | NO | NO | NO | NO | NO | NO | NO | NO | NO | NO | NO |
| D-Glucuronic acid | NO | NO | NO | NO | NO | NO | YES | NO | NO | NO | NO | NO |
| Tween 20 | NO | NO | NO | YES | NO | NO | NO | NO | NO | NO | NO | NO |
| Tween 40 | NO | NO | NO | NO | NO | YES | NO | NO | NO | NO | NO | NO |
| Tween 80 | NO | NO | YES | YES | NO | NO | NO | NO | NO | NO | NO | YES |
| Fumaric acid | NO | NO | NO | NO | NO | NO | NO | NO | NO | NO | NO | NO |
| L-Alanine | YES | YES | YES | YES | YES | YES | YES | NO | NO | YES | YES | YES |
| D-Psicose | NO | YES | NO | NO | NO | YES | NO | NO | NO | NO | NO | NO |
| D-Galactose | YES | YES | NO | YES | YES | YES | YES | YES | NO | NO | NO | NO |
| D-Gluconic acid | NO | YES | NO | NO | NO | YES | YES | YES | NO | YES | NO | NO |
| L-Rhamnose | NO | YES | NO | NO | YES | YES | YES | YES | YES | YES | YES | NO |
| a-Keto-Glutaric acid | NO | NO | YES | NO | NO | NO | YES | NO | NO | NO | YES | NO |
| a-Hydroxy Glutaric acid-?-lactone | YES | NO | NO | YES | NO | NO | YES | NO | NO | NO | YES | NO |
| Bromo succinic acid | NO | NO | NO | NO | NO | NO | NO | NO | NO | NO | NO | NO |
| L-Alanyl-Glycine | YES | YES | YES | YES | NO | NO | YES | NO | NO | NO | YES | NO |
| L-Lyxose | NO | YES | NO | NO | NO | YES | YES | YES | NO | NO | YES | NO |
| L-Aspartic acid | NO | NO | YES | NO | NO | NO | YES | YES | NO | NO | NO | NO |
| D-L-a-Glycerol phosphate | NO | NO | NO | NO | NO | NO | NO | NO | NO | NO | NO | NO |
| D-Fructose | NO | NO | NO | YES | NO | YES | YES | NO | NO | NO | YES | NO |
| a-Keto-Butyric acid | NO | NO | NO | NO | NO | NO | NO | NO | NO | NO | NO | NO |
| a-Hydroxy Butyric acid | NO | NO | NO | NO | NO | NO | NO | NO | NO | NO | NO | NO |
| Propionic acid | NO | YES | NO | NO | NO | NO | NO | NO | NO | NO | YES | NO |
| Acetoacetic acid | NO | NO | NO | NO | NO | NO | NO | NO | NO | NO | NO | NO |
| Glucuronamide | NO | NO | NO | NO | NO | NO | NO | NO | NO | NO | NO | NO |
| L-Proline | NO | YES | YES | NO | NO | NO | NO | NO | NO | NO | YES | NO |
| D-Xylose | YES | YES | YES | YES | NO | YES | YES | NO | NO | NO | YES | NO |
| Acetic acid | NO | YES | NO | YES | NO | YES | NO | NO | NO | NO | NO | NO |
| a-Methyl-D-Galactoside | NO | NO | NO | NO | YES | NO | YES | NO | NO | YES | NO | NO |
| β-Methyl-D-glucoside | NO | YES | NO | YES | YES | YES | YES | YES | NO | NO | NO | NO |
| Muck acid | YES | YES | YES | NO | NO | YES | YES | YES | NO | NO | YES | NO |
| N-acetyl-β-D-Mannosamine | NO | NO | NO | NO | NO | NO | YES | NO | YES | NO | NO | NO |
| Pyruvic acid | NO | YES | YES | YES | YES | YES | YES | YES | NO | NO | YES | NO |
| D-Alanine | YES | YES | YES | YES | YES | NO | NO | NO | NO | NO | NO | NO |
| L-Lactic acid | NO | NO | NO | NO | NO | YES | YES | NO | NO | NO | NO | NO |
| a-D-Glucose | NO | YES | YES | YES | NO | YES | YES | NO | YES | NO | NO | NO |
| a-D-Lactose | NO | NO | YES | YES | NO | NO | NO | NO | NO | NO | NO | NO |
| Adonitol | NO | YES | YES | NO | NO | NO | NO | NO | NO | NO | NO | NO |
| Glycolic acid | NO | NO | NO | NO | NO | NO | NO | NO | NO | NO | NO | NO |
| Mono Methyl Succinate | NO | NO | NO | NO | NO | NO | NO | NO | NO | NO | NO | NO |
| L-Galactonic-acid-?-lactone | NO | YES | YES | YES | YES | YES | YES | YES | NO | YES | YES | NO |
| D-Trehalose | NO | NO | NO | NO | NO | YES | YES | NO | NO | NO | NO | NO |
| Formic acid | NO | YES | NO | NO | NO | YES | NO | NO | NO | NO | NO | NO |
| Maltose | NO | YES | YES | YES | YES | YES | YES | YES | YES | NO | NO | YES |
| Lactulose | NO | NO | YES | YES | NO | NO | NO | NO | NO | NO | NO | NO |
| Maltotriose | NO | YES | YES | YES | YES | YES | YES | YES | YES | NO | NO | YES |
| Glyoxylic acid | NO | NO | NO | NO | NO | NO | NO | NO | NO | NO | NO | NO |
| Methyl Pyruvate | NO | NO | NO | NO | NO | NO | YES | YES | NO | NO | YES | NO |

TABLE 33C-continued

Substrate utilization as determined by BIOLOG PM1 MicroPlates by culturable bacteria belonging to OTUs present in landrace and wild corn and wheat seeds that are present in lower levels in modern corn and wheat seeds.

| Strain/Substrate | SYM13 | SYM18 | SYM183 | SYM184 | SYM219 | SYM43 | SYM50 | SYM508 | SYM617 | SYM620 | SYM68 | SYM905 |
|---|---|---|---|---|---|---|---|---|---|---|---|---|
| D-Galacturonic acid | NO | NO | YES | NO | NO | YES | YES | NO | NO | YES | NO | NO |
| D-Mannose | NO | YES | YES | YES | NO | YES | YES | NO | NO | NO | NO | YES |
| D-Mannitol | NO | YES | NO | YES | NO | YES | YES | NO | NO | NO | NO | NO |
| D-Melibiose | NO | YES | YES | YES | YES | YES | YES | NO | YES | NO | NO | NO |
| Sucrose | NO | NO | YES | YES | NO | YES | YES | NO | NO | NO | NO | NO |
| 2-Deoxy adenosine | NO | YES | NO | NO | NO | YES | YES | YES | NO | YES | NO | NO |
| D-Cellobiose | NO | YES | YES | YES | YES | YES | YES | YES | YES | NO | NO | YES |
| D-Malic acid | NO | NO | NO | NO | NO | NO | NO | NO | NO | NO | YES | NO |
| Phenylethyl-amine | NO | NO | NO | NO | NO | NO | NO | NO | NO | NO | NO | NO |
| Dulcitol | NO | NO | NO | NO | YES | YES | NO | NO | YES | NO | NO | NO |
| L-Glutamic acid | NO | NO | NO | NO | NO | NO | YES | NO | NO | NO | NO | NO |
| Thymidine | NO | YES | NO | NO | NO | YES | YES | YES | NO | NO | NO | NO |
| Uridine | YES | YES | YES | YES | NO | NO | YES | YES | NO | NO | NO | NO |
| Adenosine | NO | YES | NO | NO | YES | YES | NO | YES | NO | YES | NO | NO |
| Inosine | NO | NO | NO | YES | NO | NO | NO | NO | NO | NO | NO | NO |
| L-Malic acid | NO | NO | NO | NO | NO | NO | NO | NO | NO | NO | NO | NO |
| 2-Aminoethanol | NO | YES | YES | YES | NO | NO | NO | NO | NO | NO | NO | NO |

TABLE 33D

Substrate utilization as determined by BIOLOG PM2A MicroPlates by culturable bacteria belonging to OTUs present in landrace and wild corn and wheat seeds that are present in lower levels in modern corn and wheat seeds.

| Strain/Substrate | SYM13 | SYM18 | SYM183 | SYM184 | SYM219 | SYM43 | SYM50 | SYM508 | SYM617 | SYM620 | SYM68 | SYM905 |
|---|---|---|---|---|---|---|---|---|---|---|---|---|
| N-acetyl-D-Galactosamine | NO | NO | YES | YES | NO | NO | YES | NO | NO | NO | NO | YES |
| Gentiobiose | NO | YES | YES | YES | YES | YES | YES | YES | YES | YES | NO | YES |
| D-Raffinose | NO | NO | NO | NO | YES | NO | YES | NO | NO | YES | NO | NO |
| Capric acid | NO | NO | NO | NO | NO | NO | NO | NO | NO | NO | NO | NO |
| D-lactic acid methyl ester | NO | NO | NO | NO | NO | NO | YES | NO | NO | NO | NO | NO |
| Acetamide | NO | NO | NO | NO | NO | NO | NO | NO | NO | NO | YES | NO |
| L-Ornithine | YES | YES | NO | YES | YES | NO | YES | NO | NO | NO | YES | NO |
| Chondrointin sulfate C | NO | NO | NO | NO | NO | NO | NO | NO | NO | NO | NO | NO |
| N-acetyl-neuraminic acid | NO | NO | NO | NO | NO | NO | NO | NO | NO | YES | NO | NO |
| L-glucose | NO | NO | NO | NO | NO | NO | NO | NO | NO | NO | NO | NO |
| Salicin | NO | NO | YES | YES | YES | NO | YES | YES | YES | NO | NO | YES |
| Caproic acid | NO | NO | NO | NO | NO | NO | NO | YES | NO | NO | NO | NO |
| Malonic acid | NO | NO | NO | NO | NO | NO | NO | NO | NO | NO | NO | NO |
| L-Alaninamide | NO | NO | YES | YES | NO | NO | NO | NO | NO | NO | NO | YES |
| L-Phenylalanine | YES | NO | NO | NO | NO | NO | NO | NO | NO | NO | YES | NO |
| α-Cyclodextrin | NO | NO | NO | NO | NO | NO | NO | NO | NO | NO | NO | NO |
| β-D-allose | NO | NO | NO | NO | NO | NO | NO | NO | NO | NO | NO | NO |
| Lactitol | NO | NO | YES | YES | NO | NO | NO | NO | NO | NO | NO | YES |
| Sedoheptulosan | NO | NO | NO | NO | NO | NO | NO | NO | NO | NO | NO | NO |
| Citraconic acid | YES | NO | NO | NO | NO | NO | NO | NO | NO | NO | YES | NO |
| Melibionic acid | NO | NO | NO | NO | YES | NO | YES | NO | NO | YES | YES | NO |
| N-Acetyl-L-Glutamic acid | NO | NO | NO | YES | NO | NO | YES | NO | NO | NO | NO | NO |
| L-Pyroglutamic acid | YES | YES | YES | YES | YES | NO | NO | YES | NO | NO | YES | NO |
| β-Cyclodextrin | NO | NO | NO | NO | YES | NO | NO | NO | NO | NO | NO | NO |
| Amygdalin | NO | NO | YES | YES | NO | NO | NO | NO | YES | NO | NO | NO |
| D-Melezitose | NO | NO | NO | NO | NO | NO | NO | NO | YES | NO | NO | NO |
| L-Sorbose | NO | NO | NO | NO | NO | NO | NO | NO | NO | NO | NO | NO |
| Citramalic acid | NO | NO | NO | NO | NO | NO | NO | NO | NO | NO | NO | NO |
| Oxalic acid | NO | NO | NO | NO | NO | NO | NO | NO | NO | NO | NO | NO |
| L-Arginine | NO | NO | NO | NO | NO | NO | NO | NO | NO | NO | NO | NO |
| L-Valine | YES | YES | NO | YES | YES | NO | NO | NO | NO | NO | YES | NO |
| γ-Cyclodextrin | NO | NO | NO | NO | YES | NO | NO | NO | NO | NO | NO | NO |
| D-arabinose | NO | NO | NO | NO | NO | NO | NO | YES | NO | NO | NO | NO |
| Maltitol | NO | NO | YES | YES | NO | NO | NO | NO | NO | NO | NO | YES |
| Stachyose | NO | NO | NO | NO | NO | NO | NO | NO | NO | NO | NO | NO |
| D-Glucosamine | YES | YES | YES | YES | YES | YES | YES | YES | YES | NO | YES | YES |
| Oxalomalic acid | YES | YES | YES | YES | NO | YES | NO | NO | YES | NO | YES | YES |

TABLE 33D-continued

Substrate utilization as determined by BIOLOG PM2A MicroPlates by culturable bacteria belonging to OTUs present in landrace and wild corn and wheat seeds that are present in lower levels in modern corn and wheat seeds.

| Strain/Substrate | SYM13 | SYM18 | SYM183 | SYM184 | SYM219 | SYM43 | SYM50 | SYM508 | SYM617 | SYM620 | SYM68 | SYM905 |
|---|---|---|---|---|---|---|---|---|---|---|---|---|
| Glycine | NO | NO | NO | NO | NO | NO | NO | NO | NO | NO | NO | NO |
| D,L-Carnitine | YES | YES | NO | NO | NO | NO | NO | NO | NO | NO | NO | NO |
| Dextrin | NO | NO | NO | YES | YES | NO | NO | YES | YES | YES | NO | NO |
| D-arabitol | NO | NO | NO | NO | NO | NO | NO | YES | NO | NO | NO | NO |
| a-Methyl-D-Glucoside | NO | NO | NO | NO | NO | NO | NO | NO | NO | NO | NO | NO |
| D-Tagatose | NO | NO | NO | NO | NO | NO | NO | YES | NO | NO | NO | NO |
| 2-Hydroxy benzoic acid | NO | NO | NO | NO | NO | NO | NO | NO | NO | NO | NO | NO |
| Quinic acid | NO | NO | NO | NO | NO | NO | NO | NO | NO | NO | NO | NO |
| L-Histidine | NO | NO | NO | NO | NO | YES | NO | NO | NO | YES | NO | NO |
| Sec-Butylamine | NO | NO | NO | NO | NO | NO | NO | NO | NO | NO | NO | NO |
| Gelatin | NO | NO | YES | YES | NO | NO | NO | NO | NO | NO | NO | YES |
| L-arabitol | NO | NO | NO | NO | NO | NO | NO | NO | NO | NO | NO | NO |
| β-Methyl-D-Galactoside | NO | NO | NO | YES | NO | NO | NO | YES | NO | YES | NO | NO |
| Turanose | NO | NO | YES | YES | NO | NO | NO | NO | NO | NO | NO | NO |
| 4-Hydroxy benzoic acid | NO | NO | NO | NO | NO | NO | NO | NO | NO | NO | NO | NO |
| D-Ribono-1,4-Lactone | NO | NO | NO | NO | NO | NO | NO | NO | NO | NO | NO | NO |
| L-Homoserine | NO | NO | NO | NO | NO | NO | NO | NO | NO | NO | NO | NO |
| D,L-Octapamine | YES | YES | YES | YES | YES | NO | NO | NO | YES | NO | YES | YES |
| Glycogen | NO | NO | NO | NO | NO | NO | NO | YES | NO | NO | NO | NO |
| Arbutin | NO | NO | YES | YES | YES | NO | YES | YES | YES | NO | NO | YES |
| 3-Methyl Glucose | NO | NO | NO | NO | NO | NO | NO | YES | NO | NO | NO | NO |
| Xylitol | NO | NO | NO | YES | NO | NO | NO | NO | NO | NO | NO | NO |
| β-Hydroxy butyric acid | NO | NO | NO | NO | NO | NO | YES | YES | NO | NO | NO | NO |
| Sebacic acid | NO | NO | NO | NO | NO | NO | NO | NO | NO | NO | NO | NO |
| Hydroxy-L-Proline | NO | NO | NO | NO | NO | NO | YES | NO | NO | NO | NO | NO |
| Putrescine | NO | YES | NO | NO | NO | NO | YES | NO | NO | NO | NO | NO |
| Inulin | NO | NO | YES | YES | YES | YES | NO | NO | NO | NO | NO | NO |
| 2-Deoxy-D-Ribose | NO | NO | NO | NO | NO | NO | NO | YES | NO | YES | NO | NO |
| β-Methyl-D-Glucuronic acid | NO | NO | NO | NO | NO | NO | NO | NO | NO | NO | NO | NO |
| N-Acetyl-D-glucosaminitol | NO | NO | NO | NO | NO | NO | NO | NO | NO | NO | NO | NO |
| γ-Hydroxy butyric acid | NO | NO | NO | NO | NO | NO | NO | NO | NO | NO | NO | NO |
| Sorbic acid | NO | NO | NO | NO | NO | NO | NO | NO | NO | NO | NO | NO |
| L-Isoleucine | YES | NO | NO | NO | NO | NO | NO | YES | NO | NO | YES | NO |
| Dihydroxy acetone | NO | NO | NO | YES | NO | NO | YES | YES | NO | NO | NO | NO |
| Laminarin | NO | NO | NO | NO | NO | NO | NO | NO | NO | NO | NO | NO |
| i-Erythritol | NO | NO | NO | NO | NO | NO | NO | NO | NO | NO | NO | NO |
| a-Methyl-D-Mannoside | NO | NO | NO | NO | NO | NO | NO | NO | NO | NO | NO | NO |
| γ-amino butyric acid | YES | YES | NO | NO | NO | YES | NO | NO | NO | NO | NO | NO |
| a-Keto-valeric acid | NO | NO | NO | NO | NO | NO | NO | NO | NO | NO | NO | NO |
| Succinamic acid | NO | NO | NO | NO | NO | NO | NO | NO | NO | NO | NO | NO |
| L-Leucine | YES | NO | NO | NO | NO | NO | NO | NO | NO | NO | NO | NO |
| 2,3-Butanediol | YES | NO | NO | NO | NO | NO | NO | NO | NO | NO | NO | NO |
| Mannan | NO | NO | NO | NO | NO | NO | NO | NO | NO | NO | NO | NO |
| D-Fucose | NO | NO | NO | NO | NO | NO | NO | NO | NO | NO | NO | NO |
| β-Methyl-D-Xyloside | NO | NO | NO | NO | NO | NO | NO | NO | NO | NO | NO | NO |
| d-amino valeric acid | NO | NO | NO | NO | NO | NO | NO | NO | NO | NO | NO | NO |
| Itaconic acid | NO | NO | NO | NO | NO | NO | YES | YES | NO | NO | NO | NO |
| D-Tartaric acid | NO | NO | NO | NO | NO | NO | NO | NO | NO | NO | NO | NO |
| L-Lysine | NO | NO | NO | NO | NO | NO | NO | NO | NO | NO | NO | NO |
| 2,3-Butanone | NO | NO | NO | NO | NO | NO | NO | NO | NO | NO | NO | NO |
| Pectin | NO | NO | NO | NO | NO | NO | NO | YES | NO | NO | NO | NO |
| 3-0-β-D-Galactopyranosyl-D-arabinose | NO | NO | NO | NO | NO | NO | NO | NO | NO | NO | NO | NO |
| Palatinose | NO | NO | YES | YES | YES | NO | NO | NO | NO | NO | NO | YES |
| Butyric acid | NO | NO | NO | NO | NO | NO | NO | NO | NO | NO | NO | NO |
| 5-Keto-D-Gluconic acid | NO | YES | NO | NO | NO | YES | NO | YES | NO | NO | NO | NO |

TABLE 33D-continued

Substrate utilization as determined by BIOLOG PM2A MicroPlates by culturable bacteria belonging to OTUs present in landrace and wild corn and wheat seeds that are present in lower levels in modern corn and wheat seeds.

| Strain/Substrate | SYM13 | SYM18 | SYM183 | SYM184 | SYM219 | SYM43 | SYM50 | SYM508 | SYM617 | SYM620 | SYM68 | SYM905 |
|---|---|---|---|---|---|---|---|---|---|---|---|---|
| L-Tartaric acid | YES | YES | NO | NO | NO | YES | NO | YES | NO | NO | NO | NO |
| L-Methionine | NO | NO | NO | NO | NO | NO | NO | NO | NO | NO | NO | NO |
| 3-Hydroxy 2-Butanone | NO | NO | NO | NO | NO | NO | NO | NO | NO | NO | NO | NO |
| N-acetyl-D-Galactosamine | NO | NO | YES | YES | NO | NO | YES | NO | NO | NO | NO | YES |
| Gentiobiose | NO | YES | YES | YES | YES | YES | YES | YES | YES | YES | NO | YES |
| D-Raffinose | NO | NO | NO | NO | YES | NO | YES | NO | NO | YES | NO | NO |
| Capric acid | NO | NO | NO | NO | NO | NO | NO | NO | NO | NO | NO | NO |
| D-lactic acid methyl ester | NO | NO | NO | NO | NO | NO | YES | NO | NO | NO | NO | NO |
| Acetamide | NO | NO | NO | NO | NO | NO | NO | NO | NO | NO | YES | NO |
| L-Ornithine | YES | YES | NO | YES | YES | NO | YES | NO | NO | NO | YES | NO |
| Chondrointin sulfate C | NO | NO | NO | NO | NO | NO | NO | NO | NO | NO | NO | NO |
| N-acetyl-neuraminic acid | NO | NO | NO | NO | NO | NO | NO | NO | NO | YES | NO | NO |
| L-glucose | NO | NO | NO | NO | NO | NO | NO | NO | NO | NO | NO | NO |
| Salicin | NO | NO | YES | YES | YES | NO | YES | YES | YES | NO | NO | YES |
| Caproic acid | NO | NO | NO | NO | NO | NO | NO | YES | NO | NO | NO | NO |
| Malonic acid | NO | NO | NO | NO | NO | NO | NO | NO | NO | NO | NO | NO |
| L-Alaninamide | NO | NO | YES | YES | NO | NO | NO | NO | NO | NO | NO | YES |
| L-Phenylalanine | YES | NO | NO | NO | NO | NO | NO | NO | NO | NO | YES | NO |
| a-Cyclodextrin | NO | NO | NO | NO | NO | NO | NO | NO | NO | NO | NO | NO |
| β-D-allose | NO | NO | NO | NO | NO | NO | NO | NO | NO | NO | NO | NO |
| Lactitol | NO | NO | YES | YES | NO | NO | NO | NO | NO | NO | NO | YES |
| Sedoheptulosan | NO | NO | NO | NO | NO | NO | NO | NO | NO | NO | NO | NO |
| Citraconic acid | YES | NO | NO | NO | NO | NO | NO | NO | NO | NO | YES | NO |
| Melibionic acid | NO | NO | NO | NO | YES | NO | YES | NO | NO | YES | YES | NO |
| N-Acetyl-L-Glutamic acid | NO | NO | NO | YES | NO | NO | YES | NO | NO | NO | NO | NO |
| L-Pyroglutamic acid | YES | YES | YES | YES | YES | NO | NO | YES | NO | NO | YES | NO |
| β-Cyclodextrin | NO | NO | NO | NO | YES | NO | NO | NO | NO | NO | NO | NO |
| Amygdalin | NO | NO | YES | YES | NO | NO | NO | NO | NO | YES | NO | NO |
| D-Melezitose | NO | NO | NO | NO | NO | NO | NO | NO | NO | YES | NO | NO |
| L-Sorbose | NO | NO | NO | NO | NO | NO | NO | NO | NO | NO | NO | NO |
| Citramalic acid | NO | NO | NO | NO | NO | NO | NO | NO | NO | NO | NO | NO |
| Oxalic acid | NO | NO | NO | NO | NO | NO | NO | NO | NO | NO | NO | NO |
| L-Arginine | NO | NO | NO | NO | NO | NO | NO | NO | NO | NO | NO | NO |
| L-Valine | YES | YES | NO | YES | YES | NO | NO | NO | NO | NO | YES | NO |
| γ-Cyclodextrin | NO | NO | NO | NO | YES | NO | NO | NO | NO | NO | NO | NO |
| D-arabinose | NO | NO | NO | NO | NO | NO | NO | YES | NO | NO | NO | NO |
| Maltitol | NO | NO | YES | YES | NO | NO | NO | NO | NO | NO | NO | YES |
| Stachyose | NO | NO | NO | NO | NO | NO | NO | NO | NO | NO | NO | NO |
| D-Glucosamine | YES | YES | YES | YES | YES | YES | YES | YES | YES | NO | YES | YES |
| Oxalomalic acid | YES | YES | YES | YES | NO | YES | NO | NO | YES | NO | YES | YES |
| Glycine | NO | NO | NO | NO | NO | NO | NO | NO | NO | NO | NO | NO |
| D,L-Carnitine | YES | YES | NO | NO | NO | NO | NO | NO | NO | NO | NO | NO |
| Dextrin | NO | NO | NO | YES | YES | NO | NO | YES | YES | YES | NO | NO |
| D-arabitol | NO | NO | NO | NO | NO | NO | NO | YES | NO | NO | NO | NO |
| a-Methyl-D-Glucoside | NO | NO | NO | NO | NO | NO | NO | NO | NO | NO | NO | NO |
| D-Tagatose | NO | NO | NO | NO | NO | NO | NO | YES | NO | NO | NO | NO |
| 2-Hydroxy benzoic acid | NO | NO | NO | NO | NO | NO | NO | NO | NO | NO | NO | NO |
| Quinic acid | NO | NO | NO | NO | NO | NO | NO | NO | NO | NO | NO | NO |
| L-Histidine | NO | NO | NO | NO | YES | NO | NO | NO | YES | NO | NO | NO |
| Sec-Butylamine | NO | NO | NO | NO | NO | NO | NO | NO | NO | NO | NO | NO |
| Gelatin | NO | NO | YES | YES | NO | NO | NO | NO | NO | NO | NO | YES |
| L-arabitol | NO | NO | NO | NO | NO | NO | NO | NO | NO | NO | NO | NO |
| β-Methyl-D-Galactoside | NO | NO | NO | YES | NO | NO | NO | YES | NO | YES | NO | NO |
| Turanose | NO | NO | YES | YES | NO | NO | NO | NO | NO | NO | NO | NO |
| 4-Hydroxy benzoic acid | NO | NO | NO | NO | NO | NO | NO | NO | NO | NO | NO | NO |
| D-Ribono-1,4-Lactone | NO | NO | NO | NO | NO | NO | NO | NO | NO | NO | NO | NO |
| L-Homoserine | NO | NO | NO | NO | NO | NO | NO | NO | NO | NO | NO | NO |
| D,L-Octopamine | YES | YES | YES | YES | YES | NO | NO | NO | YES | NO | YES | YES |
| Glycogen | NO | NO | NO | NO | NO | NO | NO | YES | NO | NO | NO | NO |
| Arbutin | NO | NO | YES | YES | YES | NO | YES | YES | YES | NO | NO | YES |
| 3-Methyl Glucose | NO | NO | NO | NO | NO | NO | NO | YES | NO | NO | NO | NO |
| Xylitol | NO | NO | NO | YES | NO | NO | NO | NO | NO | NO | NO | NO |

TABLE 33D-continued

Substrate utilization as determined by BIOLOG PM2A MicroPlates by culturable bacteria belonging to OTUs present in landrace and wild corn and wheat seeds that are present in lower levels in modern corn and wheat seeds.

| Strain/Substrate | SYM13 | SYM18 | SYM183 | SYM184 | SYM219 | SYM43 | SYM50 | SYM508 | SYM617 | SYM620 | SYM68 | SYM905 |
|---|---|---|---|---|---|---|---|---|---|---|---|---|
| β-Hydroxy butyric acid | NO | NO | NO | NO | NO | NO | YES | YES | NO | NO | NO | NO |
| Sebacic acid | NO | NO | NO | NO | NO | NO | NO | NO | NO | NO | NO | NO |
| Hydroxy-L-Proline | NO | NO | NO | NO | NO | NO | YES | NO | NO | NO | NO | NO |
| Putrescine | NO | YES | NO | NO | NO | NO | YES | NO | NO | NO | NO | NO |
| Inulin | NO | NO | YES | YES | YES | YES | NO | NO | NO | NO | NO | NO |
| 2-Deoxy-D-Ribose | NO | NO | NO | NO | NO | NO | NO | YES | NO | YES | NO | NO |
| β-Methyl-D-Glucuronic acid | NO | NO | NO | NO | NO | NO | NO | NO | NO | NO | NO | NO |
| N-Acetyl-D-glucosaminitol | NO | NO | NO | NO | NO | NO | NO | NO | NO | NO | NO | NO |
| γ-Hydroxy butyric acid | NO | NO | NO | NO | NO | NO | NO | NO | NO | NO | NO | NO |
| Sorbic acid | NO | NO | NO | NO | NO | NO | NO | NO | NO | NO | NO | NO |
| L-Isoleucine | YES | NO | NO | NO | NO | NO | NO | YES | NO | NO | YES | NO |
| Dihydroxy acetone | NO | NO | NO | YES | NO | NO | YES | YES | NO | NO | NO | NO |
| Laminarin | NO | NO | NO | NO | NO | NO | NO | NO | NO | NO | NO | NO |
| i-Erythritol | NO | NO | NO | NO | NO | NO | NO | NO | NO | NO | NO | NO |
| a-Methyl-D-Mannoside | NO | NO | NO | NO | NO | NO | NO | NO | NO | NO | NO | NO |
| γ-amino butyric acid | YES | YES | NO | NO | NO | YES | NO | NO | NO | NO | NO | NO |
| a-Keto-valeric acid | NO | NO | NO | NO | NO | NO | NO | NO | NO | NO | NO | NO |
| Succinamic acid | NO | NO | NO | NO | NO | NO | NO | NO | NO | NO | NO | NO |
| L-Leucine | YES | NO | NO | NO | NO | NO | NO | NO | NO | NO | NO | NO |
| 2,3-Butanediol | YES | NO | NO | NO | NO | NO | NO | NO | NO | NO | NO | NO |
| Mannan | NO | NO | NO | NO | NO | NO | NO | NO | NO | NO | NO | NO |
| D-Fucose | NO | NO | NO | NO | NO | NO | NO | NO | NO | NO | NO | NO |
| β-Methyl-D-Xyloside | NO | NO | NO | NO | NO | NO | NO | NO | NO | NO | NO | NO |
| d-amino valeric acid | NO | NO | NO | NO | NO | NO | NO | NO | NO | NO | NO | NO |
| Itaconic acid | NO | NO | NO | NO | NO | NO | YES | YES | NO | NO | NO | NO |
| D-Tartaric acid | NO | NO | NO | NO | NO | NO | NO | NO | NO | NO | NO | NO |
| L-Lysine | NO | NO | NO | NO | NO | NO | NO | NO | NO | NO | NO | NO |
| 2,3-Butanone | NO | NO | NO | NO | NO | NO | NO | NO | NO | NO | NO | NO |
| Pectin | NO | NO | NO | NO | NO | NO | NO | YES | NO | NO | NO | NO |
| 3-0-β-D-Galactopyranosyl-D-arabinose | NO | NO | NO | NO | NO | NO | NO | NO | NO | NO | NO | NO |
| Palatinose | NO | NO | YES | YES | YES | NO | NO | NO | NO | NO | NO | YES |
| Butyric acid | NO | NO | NO | NO | NO | NO | NO | NO | NO | NO | NO | NO |
| 5-Keto-D-Gluconic acid | NO | YES | NO | NO | NO | YES | NO | YES | NO | NO | NO | NO |
| L-Tartaric acid | YES | YES | NO | NO | NO | YES | NO | YES | NO | NO | NO | NO |
| L-Methionine | NO | NO | NO | NO | NO | NO | NO | NO | NO | NO | NO | NO |
| 3-Hydroxy 2-Butanone | NO | NO | NO | NO | NO | NO | NO | NO | NO | NO | NO | NO |

Twelve SYM strains of culturable bacteria belonging to OTUs present in landrace and wild corn and wheat seeds that are present in lower levels in modern corn and wheat seeds were tested for sole carbon substrate utilization using BIOLOG PM1 and PM2A MicroPlates. The most utilized substrates by these strains are L-alanine, L-galactonic-acid-γ-lactone, maltose, maltotriose, D-cellobiose, gentiobiose, and D-glucosamine. The least utilized substrates by L-asparagine, L-glutamine, D-aspartic acid, tricarballylic acid, L-serine, L-fucose, 1,2-propanediol, D-threonine, L-threonine, succinic acid, fumaric acid, bromo succinic acid, D-L-a-glycerol phosphate, a-keto-butyric acid, a-hydroxy butyric acid, acetoacetic acid, glucuronamide, glycolic acid, mono methyl succinate, glyoxylic acid, phenylethyl-amine, and L-malic acid.

The substrates most utilized by a large number of the culturable bacteria belonging to core OTUs are mucic acid, L-arabinose, L-galactonic-acid-γ-lactone, N-acetyl-D-glucosamine, maltose, maltotriose, and D-cellobiose. These core bacteria did not utilize sedoheptulosan, oxalic acid, 2-hydroxy benzoic acid, quinic acid, mannan, L-methionine, N-acetyl-D-glucosaminitol, sorbic acid, 2,3-butanone, succinic acid, phenylethyl-amine, and 3-hydroxy 2-butanone as sole carbon sources. Results for the culturable fungi belonging to core OTUs indicate that D-sorbitol, L-arabinose, N-acetyl-D-glucosamine, glycerol, tween 40, tween 80, D-gluconic acid, L-proline, a-D-glucose, D-trehalose, maltose, lactulose, D-mannose, D-mannitol, sucrose, D-cellobiose, L-glutamic acid, L-ornithine, and L-pyroglutamic acid are carbon substrates that are utilized by a large number of the endophyte strains examined here. The carbon substrate that seemed to be not utilized by fungi in these assays is 2-deoxy-D-ribose. All other substrates could be utilized as a sole carbon nutrient by at least one fungi SYM strain.

Example 6

Testing of Culturable Bacterial and Fungal Endophytes Belonging to OTUs Present in Landrace and Wild Corn and Wheat Seeds that have been Lost in Modern Corn and Wheat Seeds The results shown above demonstrate that culturable microbes belonging to the same OTUs present in landrace and wild corn and wheat seeds that have been lost in modern corn and wheat seeds possess activities that could impart beneficial traits to a plant upon colonization. The aim of the experiments in this section addresses the ability of these culturable bacterial and fungal endophytes to confer beneficial traits on a host plant. Several different methods were used to ascertain this. First, plants inoculated with bacteria or fungi were tested under conditions without any stress to determine whether the microbe confers an increase in vigor. Second, endophyte-inoculated plants were tested under water stress conditions to test whether the microbes confer an increase in tolerance to this stress. These growth tests were performed using growth assays on filter paper.

Seeds, Seed Sterilization and Seed Inoculation

Corn seeds were surface-sterilized with chlorine gas as described for Example 5. Inocula were also prepared and seeds inoculated as described in Example 5.

Filter Paper Growth Assay

Bacterial endophytes isolated from seeds as described herein were tested for their ability to promote plant growth under normal and stressed conditions by inoculating maize seeds with those endophytes and germinating them on filter paper. Each bacterial endophyte to be tested was streaked out onto 20% Tryptic Soy Agar, forming a lawn on regular Petri dishes (9 cm in diameter). Once the bacteria grew to high density, which happened after one or two days depending on the bacterial growth rate, a plate per bacterial strain was scraped with the aid of a sterile loop (filling the entire hole of the loop and producing a droplet of bacterial biomass of about 20 mg). The bacteria collected in this way were transferred into 1 ml of sterile 50 mM Phosphate Buffer Saline (PBS) in a microcentrifuge tube and fully resuspended by vortexing for ~20 sec at maximum speed. This method achieves highly concentrated (~0.5-1 optical density, corresponding to about $10^8$ CFU/mL) and viable bacteria pre-adapted to live coating a surface.

Inoculation of seeds was performed by aliquoting ~100 seeds into a 50 ml sterile test tube with conical bottom. Sodium Alginate (SA) was used as a sticker and added to the seeds in a proportion of 8.4 ml/kg of seed. After applying the appropriate volume of SA with the aid of an automated pipette, the seeds were shook to ensure homogeneous coating. Immediately after adding the SA, an equal volume of the bacterial suspension was added to the seeds and these were gently shooked to ensure homogeneous coating.

Filter papers were autoclaved and placed into Petri dishes, and then presoaked with treatment solutions. To simulate normal conditions, 4 mL sterile water was added to the filters. Drought and saline stresses were induced by adding 4 mL 8% PEG 6000 solution or 100 mM NaCl to the filter papers. Eight seeds were plated in triplicate for each condition tested. The Petri dishes were sealed with surgical tape to avoid evaporative water loss and premature drying of the filter papers, randomized inside cardboard boxes to avoid position effects and placed in a growth chamber set at 22° C., 60% relative humidity, in the dark for five days.

Scoring of Results and Data Analysis

Once the seedlings had been growing for the prescribed period of time, they were removed from petri dishes, mounted on black cardboard backing, and photographed. After the seedlings were photographed, the images were processed to recover phenotypic measurements for further statistical analysis. The image-processing pipeline consisted of a cropping method that isolated the seedling assay from the peripheral metadata, a segmentation method that isolated individual seedlings from the background, and a rapid phenotyping tool that measured features of isolated seedling root morphologies.

Raw images were cropped using matrix rotation and sub-sampling methods included in the numpy python package. (van Rossum 2006, van der Walt 2011) Further segmentation on the cropped images was performed differently depending on crop genotype: soy seedlings were segmented using a watershed algorithm on the discreet Sobel gradient of the grayscale cropped image, while wheat and corn seedlings were segmented using Otsu's binary thresholding algorithm on the discreet Laplacian gradient of a Gaussian kernel convolved with the greyscale cropped image (Ando 2000, Otsu 1979). Image processing was performed using tools included in the Scikit-Image python package (vanderWalt, et al., 2014). Finally, the whole seedling biomass (root and shoot) of each treatment was determined using our own image processing metric.

Experimental Results

The effects of bacterial and fungal endophytes belonging to OTUs present in landrace and wild seeds, and combinations of bacterial endophytes or fungal endophytes, on the growth of corn seeds in a filter paper assay is shown in Table 34A and 34B.

TABLE 34A

Growth of corn seeds treated with bacterial endophytes belonging to OTUs present in landrace and wild seeds that are found at lower levels in modern seeds.

| Strain | SEQ ID NO. | Normal | Biological Effect? | Water stress | Biological Effect? | Salt stress | Biological Effect? |
|---|---|---|---|---|---|---|---|
| SYM00013 | 3590 | 1 | no | 2 | yes | 1 | yes |
| SYM00018 | 3592 | 1 | no | 0 | no | 2 | yes |
| SYM00021b | 3594 | 1 | no | 1 | yes | 0 | yes |
| SYM00025 | 3595 | 2 | yes | 0 | no | 1 | yes |
| SYM00043 | 3598 | 0 | yes | 0 | yes | 0 | yes |
| SYM00044 | 3599 | 1 | no | 0 | yes | 0 | yes |
| SYM00074 | 3608 | 1 | no | 1 | yes | 2 | yes |
| SYM00184 | 3621 | 1 | yes | 2 | yes | 0 | no |
| SYM00219 | 3624 | 0 | yes | 0 | yes | 0 | yes |
| SYM00545 | 3637 | 0 | yes | 0 | yes | 0 | yes |
| SYM00549 | 3638 | 0 | yes | 0 | yes | 0 | yes |
| SYM00617 | 3645 | 1 | no | 2 | yes | 0 | yes |

TABLE 34A-continued

Growth of corn seeds treated with bacterial endophytes belonging to OTUs present in landrace and wild seeds that are found at lower levels in modern seeds.

| Strain | SEQ ID NO. | Normal | Biological Effect? | Water stress | Biological Effect? | Salt stress | Biological Effect? |
|---|---|---|---|---|---|---|---|
| SYM00620 | 3646 | 1 | yes | 2 | yes | 0 | yes |
| SYM00646 | 3651 | 0 | yes | 0 | yes | 0 | yes |
| SYM00662 | 3653 | 1 | yes | 0 | yes | 1 | no |
| SYM00905 | 3663 | 1 | yes | 0 | no | 1 | yes |

0 indicates <0% effect, 1 indicates <20% effect, 2 indicates <40% effect, 3 indicates >40% effect.
For Biological Effect: yes indicates >5% or <−5% effect, no indicates effect between −5% and +5%.

In the salt stress, 12.5% of the microbial inoculants elicited >40% improvement on plant phenotype compared to seeds that were treated with the formulation suggesting a role in improving plant vigor under a salt stress condition. One of the two top performers is *Pantoea* sp. (SYM00018) and these strains were among the highest auxin producers tested which may indicate important beneficial traits for the plant associated with this genus. Under water stress, 25% of the microbial inoculants elicited >40% improvement on plant phenotype suggesting a role in improving plant vigor under a water stress condition. The four strains which provided the largest improvement to plant phenotype came from different genera, and two of them, SYM00013 and SYM00184, showed the ability to utilize a number of different carbon substrates including: L-Arabinose, N-Acetyl-D-Glucosamine, L-Alanine, D-Galactose, a-Hydroxy Glutaric acid-?-lactone, L-Alanyl-Glycine, D-Xylose, Mucic acid, D-Alanine and Uridine. This suggests that they may have similar roles in providing water stress protection for the plant. Under normal condition, 6.25% of the microbial inoculants elicited >40% improvement on plant phenotype compared to seeds that were treated with the formulation suggesting a role in improving plant vigor under a salt stress condition. The top performer under normal condition is *Pantoea* sp. (SYM00018) and these strains were among the highest auxin producers tested which may indicate important beneficial traits for the plant associated with this genus.

TABLE 34B

Growth of corn seeds treated with combinations of bacterial endophytes belonging to OTUs present in landrace and wild seeds that are found at lower levels in modern seeds.

| Strain 1 | SEQ ID NO. | Strain 2 | SEQ ID NO. | Normal * | Water stress * |
|---|---|---|---|---|---|
| SYM00025 | 3595 | SYM00044 | 3599 | 0 | 0/a |
| SYM00043 | 3598 | SYM00018 | 3592 | − | 0 |
| SYM00074 | 3608 | SYM00184 | 3621 | 0 | − |
| SYM00549 | 3638 | SYM00617 | 3645 | 0/−b | 0/a |
| SYM00646 | 3651 | SYM00662 | 3653 |  | +/a, b, c |

TABLE 34B-continued

Growth of corn seeds treated with combinations of bacterial endophytes belonging to OTUs present in landrace and wild seeds that are found at lower levels in modern seeds.

| Strain 1 | SEQ ID NO. | Strain 2 | SEQ ID NO. | Normal * | Water stress * |
|---|---|---|---|---|---|
| SYM00662 | 3653 | SYM00025 | 3595 | −/−b | +/a |
| SYM00905 | 3663 | SYM00043 | 3598 | −/−b | 0 |

* Any symbol to the left of the "/" pertains to primary radicle length with +, 0, − denoting an increase, no change, or decrease relative to control seedling radicles, respectively.
The scale (a-e) to the right of the "/" pertains to relative increases or decreases in secondary characteristics of the seedlings as follows: a) root hair development, b) lateral root number, c) lateral root size, d) shoot length, and e) root thickness.

A beneficial plant microbiome is likely made up of multiple strains that occupy stress protection niches within the plant. These particular bacterial endophyte combinations were evaluated in a germination assays to test the improvement on the plant phenotype conferred by inoculation with multiple bacterial strains. In water stressed plants the combination SYM00646/SYM00662 and SYM00662/SYM00025 provided improvement in plant phenotype compared to the formulation control.

Example 8

Identification and Characterization of Culturable Bacterial and Fungal Endophytes Belonging to Core OTUs Isolation and Identification of Culturable Microbes In order to better understand the role played by core seed-derived endophytic microbes in improving the vigor, general health and stress resilience of agricultural plants, we identified culturable microbes that belong to the same OTUs as the core OTUs of Tables 13 and 14. Using the same methods as in Example 3 and other techniques known in the art, bacterial and fungal endophytes were cultured were from a variety of plant parts and a variety of plants. To accurately characterize the isolated microbial endophytes, colonies were submitted for marker gene sequencing, and the sequences were analyzed to provide taxonomic classifications. Among the cultured microbes, those with at least 97% 16S or ITS sequence similarity to certain microbes of Tables 13 and 14 were identified. Those microbes are listed in Tables 35A and 35B.

TABLE 35A

Cultured bacterial isolates belonging to the same OTUs as certain bacteria of Table 13.

| Cultured bacterial isolate | SEQ ID NO of cultured bacterial isolate | SEQ ID NO of core bacterial taxa | Old OTU of core bacterial taxa | New OTU of core bacterial taxa |
|---|---|---|---|---|
| SYM00003 | 3588 | 20 | 58 | B0.9|GG99|238752 |
| SYM00009 | 3589 | 20 | 58 | B0.9|GG99|238752 |

TABLE 35A-continued

Cultured bacterial isolates belonging to the same OTUs as certain bacteria of Table 13.

| Cultured bacterial isolate | SEQ ID NO of cultured bacterial isolate | SEQ ID NO of core bacterial taxa | Old OTU of core bacterial taxa | New OTU of core bacterial taxa |
|---|---|---|---|---|
| SYM00013 | 3590 | 33 | 7 | B0.9|GG99|4327501 |
| SYM00017A | 3591 | 803 | 54 | B0.9|GG99|5409 |
| SYM00018 | 3592 | 31 | 3489 | B0.9|GG97|2582263 |
| SYM00020 | 3593 | 32 | 1255 | B0.9|GG97|2582263 |
| SYM00033 | 3596 | 1953 | 2912 | B0.9|GG97|253061 |
| SYM00050 | 3600 | 26, 28, 24, 25, 1939, 1548 | OTU_3592, OTU_1384, OTU_3629, OTU_2970, OTU_3153, OTU_115 | B0.9|GG97|816702, B0.9|GG99|218527, B0.9|GG97|639627, B0.9|GG97|253061, B0.9|GG97|4374146, B0.9|GG99|625742 |
| SYM00053 | 3601 | 25, 27, 28, 29, 32, 1953 | 2970, X, 1384, X, X, 2912 | |
| SYM00062C | 3603 | 15 | 62 | B0.9|GG99|685917 |
| SYM00065 | 3604 | 11, 891, 892, 895 | 23, 3209, 3351, 568 | B0.9|GG99|2929397, B0.9|GG99|4450360, B0.9|GG97|158370, B0.9|GG99|2185530 |
| SYM00068 | 3606 | 33 | 7 | B0.9|GG99|4327501 |
| SYM00070 | 3607 | 30 | 2 | B0.9|GG99|9943 |
| SYM00103 | 3609 | 20 | 58 | B0.9|GG99|238752 |
| SYM00170 | 3619 | 1023 | 10 | B0.9|GG99|1082594 |
| SYM00183 | 3620 | 37 | 83 | B0.9|GG99|4102407 |
| SYM00184 | 3621 | 37 | 83 | B0.9|GG99|4102407 |
| SYM00207 | 3622 | 12 | 131 | B0.9|GG99|4298641 |
| SYM00212 | 3623 | 18 | 38 | B0.9|GG99|29974 |
| SYM00219 | 3624 | 18, 981, 988 | 38, 3473, 106 | B0.9|GG99|29974, B0.9|GG99|156425, B0.9|GG99|277294 |
| SYM00234 | 3625 | 1023 | 10 | B0.9|GG99|1082594 |
| SYM00236 | 3626 | 9 | 69 | B0.9|GG99|175931 |
| SYM00248 | 3627 | 30 | 2 | B0.9|GG99|9943 |
| SYM00249 | 3628 | 12, 1047 | 131, 212 | B0.9|GG99|4298641, B0.9|GG99|14492 |
| SYM00507 | 3630 | 12, 1047 | 131, 212 | B0.9|GG99|4298641, B0.9|GG99|14492 |
| SYM00508 | 3631 | 25 | 2970 | B0.9|GG97|253061 |
| SYM00525 | 3632 | 3 | 28 | B0.9|GG99|813062 |
| SYM00538A | 3633 | 891, 892 | 3209, 3351 | B0.9|GG99|4450360, B0.9|GG97|158370 |
| SYM00538B | 3634 | 1023 | 10 | B0.9|GG99|1082594 |
| SYM00538i | 3635 | 22 | 60 | B0.9|GG99|105406 |
| SYM00543 | 3636 | 14 | 59 | B0.9|GG99|144390 |
| SYM00563 | 3639 | 988 | 106 | B0.9|GG99|277294 |
| SYM00617 | 3645 | 988 | 106 | B0.9|GG99|277294 |
| SYM00620 | 3646 | 26, 28, 24, 25, 1939, 1548 | OTU_3592, OTU_1384, OTU_3629, OTU_2970, OTU_3153, OTU_115 | B0.9|GG97|816702, B0.9|GG99|218527, B0.9|GG97|639627, B0.9|GG97|253061, B0.9|GG97|4374146, B0.9|GG99|625742 |
| SYM00627 | 3648 | 27 | 35 | B0.9|GG99|370327 |
| SYM00628 | 3649 | 25, 27, 28, 29, 30, 1953 | | |
| SYM00650 | 3652 | 33 | 7 | B0.9|GG99|4327501 |
| SYM00714 | 3656 | 803 | 54 | B0.9|GG99|5409 |
| SYM00905 | 3663 | 37 | 83 | B0.9|GG99|4102407 |
| SYM00924 | 3664 | 9 | 69 | B0.9|GG99|175931 |
| SYM00963 | 3665 | 29 | 319 | B0.9|GG99|295383 |
| SYM00978 | 3668 | 29, 30, 31, 32, 1953 | | |
| SYM00982 | 3666 | 22 | 60 | B0.9|GG99|105406 |
| SYM00987 | 3667 | 29 | 319 | B0.9|GG99|295383 |
| SYM00991 | 3669 | 1139, 1164 | 81, 64 | B0.9|GG99|988067, B0.9|GG99|4426695 |
| SYM00999 | 3670 | 9 | 69 | B0.9|GG99|175931 |
| SYM01049 | 3671 | 25, 27, 28, 30, 1953 | | |

TABLE 35B

Cultured fungal isolates belonging to the same OTUs as certain fungi of Table 14.

| Strain | SEQ ID NO. | SEQ ID NO of core fungal taxa | Old OTU of core fungal taxa | NEW OTU of core fungal taxa |
|---|---|---|---|---|
| SYM00034 | 3597 | 2965 | 7 | F0.9\|UDYN\|210204 |
| SYM00061A | 3602 | 2965 | 7 | F0.9\|UDYN\|210204 |
| SYM00066 | 3605 | 2965 | 7 | F0.9\|UDYN\|210204 |
| SYM00120 | 3610 | 2699 | 2 | F0.9\|UDYN\|206476 |
| SYM00122 | 3611 | 2701 | 45 | F0.9\|U97\|025461 |
| SYM00123 | 3612 | 2701 | 45 | F0.9\|U97\|025461 |
| SYM00124 | 3613 | 2968 | 8 | F0.9\|UDYN\|220700 |
| SYM00129 | 3614 | 2698 | 1 | F0.9\|UDYN\|424875 |
| SYM00135 | 3615 | 2698 | 1 | F0.9\|UDYN\|424875 |
| SYM00136 | 3616 | 2698 | 1 | F0.9\|UDYN\|424875 |
| SYM00151 | 3617 | 2698 | 1 | F0.9\|UDYN\|424875 |
| SYM00154 | 3618 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM00566B | 3640 | 2965 | 7 | F0.9\|UDYN\|210204 |
| SYM00577 | 3642 | 2965 | 7 | F0.9\|UDYN\|210204 |
| SYM00590 | 3643 | 2965 | 7 | F0.9\|UDYN\|210204 |
| SYM00603 | 3644 | 2965 | 7 | F0.9\|UDYN\|210204 |
| SYM00622 | 3647 | 2965 | 7 | F0.9\|UDYN\|210204 |
| SYM00629 | 3650 | 2965 | 7 | F0.9\|UDYN\|210204 |
| SYM00663 | 3654 | 2699 | 2 | F0.9\|UDYN\|206476 |
| SYM00696 | 3655 | 2699 | 2 | F0.9\|UDYN\|206476 |
| SYM00741a | 3657 | 2741 | 10 | F0.9\|UDYN\|186595 |
| SYM00741b | 3658 | 2733, 2751, 2799 | 5, 883, 974 | F0.9\|UDYN\|212600; F0.9\|SF0\|A8L3R1114:18309:4041; |
| SYM00793 | 3659 | 2698 | 1 | F0.9\|UDYN\|424875 |
| SYM00795 | 3660 | 2965 | 7 | F0.9\|UDYN\|210204 |
| SYM00854 | 3661 | 2741 | 10 | F0.9\|UDYN\|186595 |
| SYM00880 | 3662 | 2699 | 2 | F0.9\|UDYN\|206476 |
| SYM01300 | 3672 | 2965 | 7 | F0.9\|UDYN\|210204 |
| SYM01303 | 3673 | 2968 | 8 | F0.9\|UDYN\|220700 |
| SYM01310 | 3674 | 2698 | 1 | F0.9\|UDYN\|424875 |
| SYM01311 | 3675 | 2698 | 1 | F0.9\|UDYN\|424875 |
| SYM01314 | 3676 | 2965 | 7 | F0.9\|UDYN\|210204 |
| SYM01315 | 3677 | 2733, 2751, 2799 | 5, 883, 974 | F0.9\|UDYN\|212600; F0.9\|SF0\|A8L3R1114:18309:4041; |
| SYM01325 | 3678 | 2699 | 2 | F0.9\|UDYN\|206476 |
| SYM01326 | 3679 | 2699 | 2 | F0.9\|UDYN\|206476 |
| SYM01327 | 3680 | 2733, 2751, 2799 | 5, 883, 974 | F0.9\|UDYN\|212600; F0.9\|SF0\|A8L3R1114:18309:4041; |
| SYM01328 | 3681 | 2699 | 2 | F0.9\|UDYN\|206476 |
| SYM01333 | 3682 | 2737 | 4 | F0.9\|SF97\|43 |
| SYM15811 | 3683 | 2699 | 2 | F0.9\|UDYN\|206476 |
| SYM15820 | 3684 | 2980 | 50 | F0.9\|UDYN\|177637 |
| SYM15821 | 3685 | 2980 | 50 | F0.9\|UDYN\|177637 |
| SYM15825 | 3686 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM15828 | 3687 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM15831 | 3688 | 2698 | 1 | F0.9\|UDYN\|424875 |
| SYM15837 | 3689 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM15839 | 3690 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM15847 | 3691 | 2698 | 1 | F0.9\|UDYN\|424875 |
| SYM15870 | 3692 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM15872 | 3693 | 2966, 2983 | 3, 351 | F0.9\|UDYN\|215392; F0.9\|U97\|020374 |
| SYM15890 | 3694 | 2733, 2751, 2799 | 5, 883, 974 | F0.9\|UDYN\|212600; F0.9\|SF0\|A8L3R1114:18309:4041; |

TABLE 35B-continued

Cultured fungal isolates belonging to the same OTUs as certain fungi of Table 14.

| Strain | SEQ ID NO. | SEQ ID NO of core fungal taxa | Old OTU of core fungal taxa | NEW OTU of core fungal taxa |
|---|---|---|---|---|
| SYM15901 | 3695 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM15920 | 3696 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM15926 | 3697 | 2699 | 2 | F0.9\|UDYN\|206476 |
| SYM15928 | 3698 | 2699 | 2 | F0.9\|UDYN\|206476 |
| SYM15932 | 3699 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |
| SYM15939 | 3700 | 2966, 2983, 2987, 3002 | 3, 351, 728, 766 | F0.9\|UDYN\|215392; F0.9\|U97\|020374; F0.9\|SF0\|A8L3R2113:21340:17509; F0.9\|SF0\|A8L3R2102:11106:24468 |

Characterization of Culturable Microbes: Auxin, Acetoin and Siderophore Production The culturable microbes belonging to the same OTUs as certain microbes of Tables 13 or Table 14 were then seeded onto 96 well plants and tested for auxin, acetoin and siderophore production, using the methods described in Example 4. The results are presented in Tables 36A and 36B.

TABLE 36A

Auxin, siderophore, and acetoin production by culturable bacteria belonging to core OTUs

| Strain | SEQ ID NO. | Secretes siderophores | Produces Auxin/Indoles | Produces Acetoin |
|---|---|---|---|---|
| SYM00003 | 3588 | 2 | 1 | 0 |
| SYM00009 | 3589 | 1 | 1 | 0 |
| SYM00013 | 3590 | 0 | 1 | 0 |
| SYM00017A | 3591 | 1 | 3 | 0 |
| SYM00018 | 3592 | 0 | 3 | 2 |
| SYM00020 | 3593 | 0 | 2 | 2 |
| SYM00021b | 3594 | 0 | 2 | 3 |
| SYM00025 | 3595 | 1 | 3 | 2 |
| SYM00043 | 3598 | 1 | 3 | 2 |
| SYM00044 | 3599 | 1 | 1 | 3 |
| SYM00050 | 3600 | 1 | 2 | 3 |
| SYM00053 | 3601 | 1 | 1 | 2 |
| SYM00062C | 3603 | 1 | 2 | 1 |
| SYM00068 | 3606 | 2 | 2 | 0 |
| SYM00070 | 3607 | 2 | 2 | 0 |
| SYM00074 | 3608 | 2 | 3 | 0 |
| SYM00103 | 3609 | 2 | 2 | 2 |
| SYM00183 | 3620 | 0 | 2 | 1 |
| SYM00184 | 3621 | 0 | 2 | 0 |
| SYM00207 | 3622 | 1 | 2 | 2 |
| SYM00212 | 3623 | 2 | 2 | 3 |
| SYM00219 | 3624 | 3 | 2 | 3 |
| SYM00234 | 3625 | 2 | 2 | 2 |
| SYM00236 | 3626 | 0 | 2 | 0 |
| SYM00248 | 3627 | 1 | 2 | 0 |
| SYM00249 | 3628 | 2 | 2 | 2 |
| SYM00506c | 3629 | 0 | 2 | 2 |
| SYM00507 | 3630 | 1 | 2 | 2 |
| SYM00508 | 3631 | 0 | 3 | 2 |
| SYM00525 | 3632 | 2 | 2 | 3 |
| SYM00538A | 3633 | 3 | 2 | 3 |
| SYM00538B | 3634 | 2 | 2 | 2 |
| SYM00538i | 3635 | 0 | 1 | 0 |
| SYM00543 | 3636 | 0 | 3 | 1 |
| SYM00545 | 3637 | 2 | 2 | 2 |
| SYM00549 | 3638 | 2 | 2 | 2 |
| SYM00563 | 3639 | 2 | 2 | 1 |
| SYM00574 | 3641 | 3 | 1 | 0 |
| SYM00617 | 3645 | 1 | 3 | 1 |
| SYM00620 | 3646 | 1 | 3 | 0 |
| SYM00627 | 3648 | 0 | 1 | 3 |
| SYM00628 | 3649 | 2 | 2 | 3 |
| SYM00646 | 3651 | 3 | 2 | 3 |
| SYM00650 | 3652 | 2 | 2 | 0 |
| SYM00662 | 3653 | 1 | 1 | 1 |
| SYM00714 | 3656 | 1 | 2 | 2 |
| SYM00905 | 3663 | 3 | 2 | 2 |
| SYM00924 | 3664 | 2 | 2 | 2 |
| SYM00963 | 3665 | 2 | 2 | 1 |
| SYM00978 | 3668 | 2 | 2 | 1 |
| SYM00982 | 3666 | 0 | 2 | 3 |
| SYM00987 | 3667 | 1 | 3 | 2 |
| SYM00991 | 3669 | 1 | 2 | 2 |
| SYM00999 | 3670 | 1 | 1 | 3 |
| SYM01049 | 3671 | 1 | 1 | 0 |

In total, a very large proportion of the bacteria strains, 44 out of 55 strains (80% of total) tested, were able to utilize Tryptophan supplemented in the medium and showed a detectable level of pink or red color development (the diagnostic feature of the assay suggesting auxin or indolic compound production). These include 8 *Bacillus* spp., 5 *Paenibacillus* spp., 6 *Pantoea* spp., and 5 *Enterobacter* spp. 10 strains (18% of total) had particularly strong production of auxin or indole compounds. As for acetoin production, 32 out of 21 strains (58% of total) tested showed a detectable level of pink or red color (a proxy of acetoin production). These include 6 *Enterobacter* spp., 5 *Paenibacillus* spp., and 4 *Bacillus* spp. Particularly, 12 of these 32 strains had strong production of acetoin. 23 out of 55 strains (42% of total) tested showed a detectable level of siderophore accumulation. These include 4 *Bacillus* spp., 4 *Paenibacillus* spp., 4 *Enterobacter* spp., and 3 *Pseudomonas* spp. Among these 23 strains, 5 strains showed very strong accumulation of siderophore.

TABLE 36B

Auxin, siderophore, and acetoin production by culturable fungi belonging to core OTUs

| Strain | SEQ ID NO. | Secretes siderophores | Produces Auxin/Indoles | Produces Acetoin |
|---|---|---|---|---|
| SYM00034 | 3597 | 1 | 0 | 0 |
| SYM00061A | 3602 | 1 | 0 | 2 |
| SYM00066 | 3605 | 1 | 0 | 0 |
| SYM00120 | 3610 | 1 | 0 | 0 |
| SYM00122 | 3611 | 0 | 0 | 0 |
| SYM00123 | 3612 | 1 | 0 | 3 |
| SYM00124 | 3613 | 1 | 1 | 0 |
| SYM00129 | 3614 | 0 | 1 | 0 |
| SYM00135 | 3615 | 0 | 1 | 0 |
| SYM00136 | 3616 | 0 | 0 | 1 |
| SYM00151 | 3617 | 1 | 1 | 0 |
| SYM00154 | 3618 | 0 | 0 | 0 |
| SYM00566B | 3640 | 3 | 0 | 0 |
| SYM00577 | 3642 | 0 | 0 | 1 |
| SYM00590 | 3643 | 0 | 1 | 2 |
| SYM00603 | 3644 | 2 | 1 | 0 |
| SYM00622 | 3647 | 1 | 0 | 2 |
| SYM00629 | 3650 | 0 | 1 | 2 |
| SYM00663 | 3654 | 2 | 1 | 2 |
| SYM00696 | 3655 | 2 | 0 | 0 |
| SYM00741b | 3658 | 0 | 0 | 0 |
| SYM00793 | 3659 | 1 | 0 | 0 |
| SYM00795 | 3660 | 1 | 0 | 1 |
| SYM00854 | 3661 | 2 | 0 | 2 |
| SYM00880 | 3662 | 2 | 1 | 2 |
| SYM01300 | 3672 | 2 | 1 | 0 |
| SYM01303 | 3673 | — | — | — |
| SYM01310 | 3674 | 0 | 2 | 0 |
| SYM01311 | 3675 | 0 | 0 | 0 |
| SYM01314 | 3676 | 2 | 1 | 0 |
| SYM01315 | 3677 | 0 | 0 | 0 |
| SYM01325 | 3678 | 0 | 0 | 2 |
| SYM01326 | 3679 | 0 | 0 | 2 |
| SYM01327 | 3680 | 2 | 1 | 2 |
| SYM01328 | 3681 | 1 | 0 | 0 |
| SYM01333 | 3682 | 0 | 0 | 0 |
| SYM15811 | 3683 | 3 | 1 | 0 |
| SYM15820 | 3684 | 1 | 0 | 0 |
| SYM15821 | 3685 | 1 | 0 | 0 |
| SYM15825 | 3686 | 0 | 0 | 2 |
| SYM15828 | 3687 | 0 | 0 | 2 |
| SYM15831 | 3688 | 2 | 1 | 2 |
| SYM15837 | 3689 | 1 | 0 | 0 |
| SYM15839 | 3690 | 2 | 0 | 0 |
| SYM15847 | 3691 | 0 | 0 | 0 |
| SYM15870 | 3692 | 0 | 0 | 0 |
| SYM15872 | 3693 | 0 | 0 | 1 |
| SYM15890 | 3694 | 0 | 0 | 2 |
| SYM15901 | 3695 | 0 | 0 | 2 |
| SYM15920 | 3696 | 2 | 0 | 2 |
| SYM15926 | 3697 | 1 | 2 | 0 |
| SYM15928 | 3698 | 0 | 0 | 0 |
| SYM15932 | 3699 | 0 | 0 | 0 |
| SYM15939 | 3700 | 0 | 1 | 0 |

In total, most fungi were not able to utilize L-Tryptophan supplemented in the medium. 17 out of 51 strains tested (31% of total) showed a detectable level of pink or red color development (the diagnostic feature of the assay suggesting auxin or indolic compound production). These include 5 *Acremonium* spp., 4 *Alternaria* spp., and 3 *Fusariam* spp. Only 2 strains (4% of total) had particularly strong production of auxin or indole compounds. As for acetoin production, 17 out of 54 strains (31% of total) tested showed a detectable level of pink or red color (a proxy of acetoin production). These include 5 *Fusarium* spp., 4 *Alternaria* spp., and 4 *Acremonim* spp. Particularly, only 1 of these 17 strains had strong production of acetoin. 13 out of 21 strains (24% of total) tested showed a detectable level of siderophore accumulation. These include 4 *Alternaria* spp., 4 *Acremonium* spp., and 3 *Fusarium* spp. Among these 13 strains, 2 strains showed very strong accumulation of siderophore.

Characterization of Culturable Microbes: Substrate Use

The BIOLOG protocol was conducted in the same manner as described previously. The ability of a strain to utilize a specific carbon substrate in the BIOLOG PM1 or PM2A MicroPlates could be determined by colorimetric assay and increased turbidity due to cell growth in that particular well (Tables 36C, 36D, 36E and 36F).

TABLE 36C

Substrate utilization as determined by BIOLOG PM1 MicroPlates by culturable bacteria belonging to core OTUs.

| Substrate | SYM 103 | SYM 1049 | SYM 13 | SYM 17A | SYM 18 | SYM 183 | SYM 184 | SYM 20 | SYM 207 | SYM 212 | SYM 219 | SYM 234 | SYM 236 | SYM 248 | SYM 249 | SYM 260 |
|---|---|---|---|---|---|---|---|---|---|---|---|---|---|---|---|---|
| D-Serine | NO | NO | NO | NO | NO | NO | NO | NO | NO | NO | NO | NO | NO | YES | NO | NO |
| D-Glucose-6-Phosphate | NO | NO | NO | YES | NO | NO | NO | NO | NO | YES | NO | NO | NO | YES | YES | NO |
| L-Asparagine | NO | NO | NO | YES | NO | NO | NO | NO | NO | NO | NO | NO | NO | NO | YES | YES |
| L-glutamine | NO | NO | NO | NO | NO | NO | NO | NO | NO | NO | NO | NO | NO | NO | YES | NO |
| Glycyl-L-Aspartic acid | NO | YES | YES | NO | NO | NO | NO | NO | NO | YES | NO | NO | NO | NO | NO | NO |
| Glycyl-L-Glutamic acid | YES | NO | NO | NO | NO | YES | YES | NO | YES | YES | NO | NO | NO | NO | NO | YES |
| Glycyl-L-Proline | NO | NO | NO | NO | NO | YES | YES | NO | NO | NO | NO | NO | NO | NO | NO | NO |
| L-Arabinose | NO | YES | YES | YES | YES | NO | YES | YES | NO | YES | NO | YES | YES | YES | YES | YES |
| D-Sorbitol | NO | NO | NO | YES | NO | NO | YES | NO | NO | NO | NO | NO | NO | NO | NO | NO |
| D-Galactonic acid-?-lactone | NO | YES | YES | NO | YES | NO | NO | YES | NO | NO | YES | NO | NO | NO | NO | NO |
| D-Aspartic acid | NO | NO | NO | NO | NO | NO | NO | NO | YES | NO | NO | NO | NO | NO | NO | NO |
| m-Tartaric acid | NO | YES | YES | NO | YES | NO | NO | YES | NO | YES | NO | NO | NO | NO | NO | NO |
| Citric acid | NO | NO | NO | NO | NO | NO | NO | NO | NO | NO | NO | NO | NO | NO | YES | YES |
| Tricarballylic acid | NO | NO | NO | NO | NO | NO | NO | NO | NO | YES | NO | NO | NO | NO | NO | NO |

TABLE 36C-continued

Substrate utilization as determined by BIOLOG PM1 MicroPlates by culturable bacteria belonging to core OTUs.

| Substrate | | | | | | | | | | | | | | | | |
|---|---|---|---|---|---|---|---|---|---|---|---|---|---|---|---|---|
| p-Hydroxy Phenyl acetic acid | NO | NO | NO | YES | NO | NO | NO | NO | NO | NO | NO | NO | NO | NO | NO | NO |
| N-Acetyl-D-Glucosamine | NO | NO | YES | YES | YES | YES | YES | YES | YES | YES | YES | YES | NO | YES | YES | NO |
| Glycerol | NO | NO | NO | YES | NO | NO | NO | NO | NO | YES | NO | YES | NO | YES | NO | YES |
| D-L-Malic acid | NO | NO | NO | YES | NO | NO | YES | NO | YES | YES | NO | YES | NO | NO | NO | YES |
| D-Glucosaminic acid | NO | NO | NO | YES | YES | NO | NO | YES | NO | NO | NO | NO | NO | NO | NO | NO |
| D-Glucose-1-Phosphate | NO | NO | NO | YES | YES | NO | NO | YES | NO | YES | NO | NO | NO | NO | YES | NO |
| m-Inositol | NO | NO | NO | YES | YES | NO | YES | YES | NO | YES | NO | NO | NO | YES | YES | YES |
| L-Serine | NO | NO | NO | NO | NO | NO | NO | NO | NO | NO | NO | NO | NO | NO | NO | YES |
| m-Hydroxy Phenyl Acetic acid | NO | NO | NO | NO | NO | NO | NO | NO | YES | NO | NO | NO | NO | NO | NO | NO |
| D-Saccharic acid | NO | NO | NO | YES | NO | NO | YES | NO | NO | YES | NO | NO | NO | NO | NO | YES |
| L-Fucose | NO | NO | NO | YES | NO | NO | NO | NO | NO | YES | NO | NO | NO | NO | NO | NO |
| D-Ribose | NO | YES | NO | YES | YES | YES | YES | NO | NO | YES | NO | NO | NO | YES | YES | NO |
| 1,2-Propanediol | NO | NO | NO | NO | NO | NO | NO | NO | NO | YES | NO | NO | NO | NO | NO | YES |
| D-Fructose-6-Phosphate | NO | NO | NO | YES | YES | NO | NO | NO | NO | YES | NO | NO | NO | NO | YES | NO |
| D-Threonine | NO | NO | NO | NO | NO | NO | NO | NO | NO | NO | NO | NO | NO | NO | NO | NO |
| L-Threonine | NO | NO | NO | NO | NO | NO | NO | YES | NO | NO | NO | NO | NO | NO | NO | YES |
| Tyramine | NO | NO | YES | YES | YES | YES | NO | YES | YES | YES | YES | YES | NO | YES | YES | NO |
| Succinic acid | NO | NO | NO | NO | NO | NO | NO | NO | NO | NO | NO | NO | NO | NO | NO | NO |
| D-Glucuronic acid | NO | NO | NO | NO | NO | NO | NO | NO | NO | NO | NO | NO | NO | NO | YES | NO |
| Tween 20 | NO | NO | NO | NO | NO | NO | YES | NO | NO | NO | NO | NO | NO | NO | NO | YES |
| Tween 40 | NO | NO | NO | NO | NO | NO | NO | NO | NO | NO | NO | NO | NO | NO | NO | YES |
| Tween 80 | YES | YES | NO | NO | NO | YES | YES | NO | NO | NO | NO | NO | NO | NO | NO | YES |
| Fumaric acid | NO | NO | NO | NO | NO | NO | NO | NO | YES | NO | NO | NO | NO | NO | NO | YES |
| L-Alanine | YES | NO | YES | YES | YES | YES | YES | YES | YES | YES | YES | YES | YES | YES | NO | YES |
| D-Psicose | NO | NO | NO | YES | YES | NO | NO | YES | NO | NO | NO | NO | NO | NO | NO | NO |
| D-Galactose | NO | YES | YES | YES | YES | NO | YES | YES | NO | NO | YES | NO | NO | YES | YES | NO |
| D-Gluconic acid | YES | NO | NO | NO | YES | NO | NO | NO | NO | YES | NO | YES | NO | NO | NO | YES |
| L-Rhamnose | NO | NO | NO | YES | YES | NO | NO | YES | NO | YES | YES | YES | NO | YES | YES | NO |
| a-Keto-Glutaric acid | YES | NO | NO | YES | NO | YES | NO | NO | YES | YES | NO | NO | YES | NO | NO | YES |
| a-Hydroxy Glutaric acid-?-lactone | NO | NO | YES | YES | NO | NO | YES | NO | NO | YES | NO | NO | YES | NO | NO | YES |
| Bromo succinic acid | NO | NO | NO | NO | NO | NO | NO | NO | NO | NO | NO | NO | NO | NO | NO | YES |
| L-Alanyl-Glycine | YES | NO | YES | YES | YES | YES | YES | YES | YES | YES | NO | YES | NO | YES | NO | YES |
| L-Lyxose | NO | NO | NO | NO | YES | NO | NO | YES | NO | NO | NO | NO | NO | YES | NO | NO |
| L-Aspartic acid | YES | NO | NO | NO | NO | YES | NO | NO | YES | NO | NO | NO | YES | YES | YES | YES |
| D-L-a-Glycerol phosphate | NO | NO | NO | NO | NO | NO | NO | NO | NO | NO | NO | NO | NO | NO | NO | YES |
| D-Fructose | NO | NO | NO | YES | NO | NO | YES | YES | NO | YES | NO | YES | NO | YES | NO | NO |
| a-Keto-Butyric acid | NO | NO | NO | NO | NO | NO | NO | NO | YES | YES | NO | NO | NO | NO | NO | NO |
| a-Hydroxy Butyric acid | NO | NO | NO | NO | NO | NO | NO | NO | NO | YES | NO | NO | NO | NO | NO | YES |
| Propionic acid | NO | NO | NO | YES | YES | NO | NO | NO | YES | YES | NO | NO | NO | NO | NO | YES |
| Acetoacetic acid | NO | NO | NO | NO | NO | NO | NO | NO | NO | NO | NO | NO | NO | NO | NO | YES |
| Glucuronamide | NO | NO | NO | NO | NO | NO | NO | NO | NO | NO | NO | NO | NO | NO | NO | NO |
| L-Proline | NO | NO | NO | NO | YES | YES | NO | NO | YES | YES | NO | YES | YES | YES | NO | YES |
| D-Xylose | YES | YES | YES | YES | YES | YES | YES | YES | NO | YES | NO | YES | YES | YES | NO | YES |
| Acetic acid | NO | NO | NO | YES | YES | NO | YES | NO | YES | YES | NO | YES | YES | NO | NO | YES |
| a-Methyl-D-Galactoside | NO | NO | NO | YES | NO | NO | NO | NO | NO | YES | YES | YES | NO | YES | NO | NO |
| β-Methyl-D-glucoside | NO | NO | NO | YES | YES | NO | YES | YES | NO | YES | YES | YES | NO | YES | YES | YES |
| Mucic acid | YES | YES | YES | YES | YES | YES | NO | YES | YES | YES | NO | YES | NO | YES | NO | YES |
| N-acetyl-β-D-Mannosamine | NO | NO | NO | NO | NO | NO | NO | NO | NO | NO | NO | YES | NO | NO | NO | YES |
| Pyruvic acid | NO | YES | NO | YES | YES | YES | YES | YES | YES | YES | YES | YES | NO | NO | YES | YES |
| D-Alanine | YES | NO | YES | YES | YES | YES | NO | YES | NO | YES | NO | NO | NO | YES | NO | NO |
| L-Lactic acid | NO | NO | NO | NO | NO | NO | NO | NO | NO | NO | NO | NO | NO | NO | NO | YES |
| a-D-Glucose | NO | YES | NO | YES | YES | NO | YES | YES | NO | NO | NO | YES | NO | NO | NO | NO |
| a-D-Lactose | NO | NO | NO | NO | YES | YES | NO | NO | NO | YES | NO | YES | NO | YES | NO | NO |
| Adonitol | NO | NO | NO | YES | YES | NO | NO | NO | YES | NO | YES | NO | NO | NO | NO | NO |
| Glycolic acid | YES | NO | NO | NO | NO | NO | NO | NO | YES | YES | NO | NO | NO | NO | NO | YES |

TABLE 36C-continued

Substrate utilization as determined by BIOLOG PM1 MicroPlates by culturable bacteria belonging to core OTUs.

| | | | | | | | | | | | | | | | |
|---|---|---|---|---|---|---|---|---|---|---|---|---|---|---|---|
| Mono Methyl Succinate | NO | YES | NO | NO | NO | NO | NO | NO | YES | NO | NO | YES | NO | NO | NO | YES |
| L-Galactonic-acid-?-lactone | YES | YES | NO | YES | YES | YES | YES | YES | YES | YES | YES | YES | NO | NO | NO | YES |
| D-Trehalose | YES | NO | NO | YES | NO | NO | NO | NO | NO | NO | NO | YES | NO | YES | NO | NO |
| Formic acid | NO | NO | NO | NO | YES | NO | NO | YES | NO | NO | NO | NO | NO | YES | NO | YES |
| Maltose | NO | YES | NO | YES | YES | YES | YES | YES | NO | YES | YES | NO | YES | YES | YES | YES |
| Lactulose | NO | NO | NO | YES | NO | YES | YES | NO | NO | YES | NO | YES | NO | NO | NO | NO |
| Maltotriose | NO | NO | NO | YES | YES | YES | YES | YES | NO | YES | YES | YES | NO | YES | YES | YES |
| Glyoxylic acid | NO | NO | NO | NO | NO | NO | NO | NO | NO | NO | NO | NO | NO | NO | NO | YES |
| Methyl Pyruvate | NO | NO | NO | NO | NO | NO | NO | NO | NO | YES | NO | YES | NO | NO | NO | YES |
| D-Galacturonic acid | YES | NO | NO | YES | NO | YES | NO | NO | YES | NO | NO | NO | NO | NO | NO | YES |
| D-Mannose | NO | YES | NO | YES | YES | YES | YES | NO | NO | NO | NO | YES | NO | YES | NO | NO |
| D-Mannitol | NO | NO | NO | YES | YES | NO | YES | NO | NO | NO | NO | YES | NO | YES | YES | YES |
| D-Melibiose | NO | NO | NO | YES | YES | YES | YES | NO | NO | YES | YES | YES | NO | YES | NO | NO |
| Sucrose | NO | NO | NO | YES | NO | YES | YES | NO | NO | NO | NO | YES | NO | NO | YES | NO |
| 2-Deoxy adenosine | NO | NO | NO | NO | YES | NO | NO | NO | NO | NO | NO | NO | NO | YES | NO | YES |
| D-Cellobiose | NO | YES | NO | YES | YES | YES | YES | YES | YES | YES | YES | YES | NO | YES | YES | YES |
| D-Malic acid | NO | YES | NO | NO | NO | NO | NO | NO | NO | NO | NO | NO | YES | NO | YES |
| Phenylethyl-amine | NO | NO | NO | NO | NO | NO | NO | NO | NO | NO | NO | NO | NO | NO | NO | NO |
| Dulcitol | NO | NO | NO | NO | NO | NO | NO | NO | NO | YES | NO | NO | NO | NO | NO | NO |
| L-Glutamic acid | NO | NO | NO | NO | NO | NO | NO | NO | NO | NO | NO | NO | NO | NO | NO | NO |
| Thymidine | NO | NO | NO | NO | YES | NO | NO | NO | YES | YES | NO | YES | NO | NO | YES | YES |
| Uridine | YES | NO | YES | YES | YES | YES | YES | NO | YES | YES | NO | YES | NO | NO | YES | YES |
| Adenosine | YES | NO | NO | YES | YES | NO | NO | NO | NO | YES | YES | YES | NO | YES | NO | YES |
| Inosine | NO | NO | NO | NO | NO | NO | YES | NO | YES | NO | NO | YES | NO | NO | NO | NO |
| L-Malic acid | NO | NO | NO | NO | NO | NO | NO | NO | YES | NO | NO | NO | NO | NO | NO | YES |
| 2-Aminoethanol | YES | NO | NO | YES | YES | YES | YES | NO | NO | NO | NO | YES | NO | NO | NO | YES |

| | Strain | | | | | | | | | | | | | | | | |
|---|---|---|---|---|---|---|---|---|---|---|---|---|---|---|---|---|---|
| Substrate | SYM 290 | SYM 292 | SYM 3 | SYM 43 | SYM 50 | SYM 5066 | SYM 508 | SYM 525 | SYM 53 | SYM 538A | SYM 538B | SYM 538i | SYM 543 | SYM 563 | SYM 574 | SYM 57B | SYM 617 |
| D-Serine | NO | YES | NO | NO | YES | NO | NO | NO | YES | NO | NO | NO | YES | NO | NO | NO | NO |
| D-Glucose-6-Phosphate | NO | NO | NO | YES | YES | NO | YES | NO | YES | NO | NO | NO | YES | NO | NO | NO | NO |
| L-Asparagine | NO | NO | NO | NO | NO | NO | NO | NO | NO | NO | NO | YES | NO | NO | NO | NO | NO |
| L-glutamine | NO | NO | NO | NO | NO | NO | NO | NO | NO | NO | NO | NO | NO | NO | NO | NO | NO |
| Glycyl-L-Aspartic acid | NO | NO | NO | YES | YES | NO | NO | NO | YES | NO | NO | NO | NO | NO | NO | NO | NO |
| Glycyl-L-Glutamic acid | NO | NO | NO | NO | NO | NO | NO | NO | NO | NO | NO | YES | NO | YES | NO | YES | NO |
| Glycyl-L-Proline | NO | NO | NO | NO | YES | NO | NO | NO | YES | NO | NO | NO | NO | NO | YES | NO |
| L-Arabinose | YES | YES | YES | YES | YES | NO | NO | NO | YES | NO | YES | YES | YES | YES | YES | YES | NO |
| D-Sorbitol | NO | NO | NO | NO | YES | NO | NO | YES | YES | NO | NO | NO | NO | NO | NO | NO | NO |
| D-Galactonic acid-?-lactone | NO | NO | NO | YES | NO | NO | NO | NO | NO | NO | NO | NO | NO | NO | NO | NO | NO |
| D-Aspartic acid | NO | NO | NO | NO | NO | NO | NO | NO | NO | NO | NO | NO | NO | NO | NO | NO | NO |
| m-Tartaric acid | NO | NO | NO | YES | NO | NO | NO | NO | NO | NO | NO | NO | NO | NO | NO | NO | NO |
| Citric acid | NO | YES | NO | NO | NO | NO | NO | NO | NO | NO | YES | YES | NO | YES | NO | NO | NO |
| Tricarballylic acid | NO | NO | NO | NO | NO | NO | NO | NO | NO | NO | NO | NO | NO | NO | NO | NO | NO |
| p-Hydroxy Phenyl acetic acid | NO | NO | NO | NO | YES | NO | NO | NO | NO | NO | NO | NO | NO | NO | NO | NO | NO |
| N-Acetyl-D-Glucosamine | YES | YES | YES | YES | YES | NO | NO | NO | YES | YES | YES | YES | YES | NO | YES | NO | NO |
| Glycerol | YES | YES | NO | YES | YES | NO | NO | NO | NO | NO | YES | NO | YES | NO | YES | NO | NO |
| D-L-Malic acid | YES | YES | NO | YES | NO | NO | YES | YES | NO | YES | YES | YES | YES | NO | YES | NO | YES |
| D-Glucosaminic acid | NO | NO | YES | YES | NO | NO | YES | NO | NO | NO | NO | NO | NO | NO | NO | NO | NO |
| D-Glucose-1-Phosphate | NO | NO | NO | YES | NO | NO | YES | NO | YES | NO | NO | NO | NO | NO | NO | NO | NO |
| m-Inositol | NO | YES | NO | YES | YES | NO | NO | YES | YES | NO | YES | YES | YES | NO | YES | NO | NO |
| L-Serine | NO | NO | NO | NO | NO | NO | NO | NO | NO | NO | NO | NO | YES | NO | YES | NO | NO |
| m-Hydroxy Phenyl Acetic acid | NO | NO | NO | NO | YES | NO | NO | NO | YES | NO | NO | NO | NO | NO | YES | NO |
| D-Saccharic acid | NO | YES | YES | YES | YES | NO | NO | NO | NO | NO | YES | YES | NO | YES | NO | NO |
| L-Fucose | YES | NO | NO | NO | NO | NO | NO | NO | NO | NO | NO | NO | YES | NO | YES | NO |

TABLE 36C-continued

Substrate utilization as determined by BIOLOG PM1 MicroPlates by culturable bacteria belonging to core OTUs.

| | | | | | | | | | | | | | | | | |
|---|---|---|---|---|---|---|---|---|---|---|---|---|---|---|---|---|
| D-Ribose | YES | YES | YES | YES | NO | NO | NO | YES | NO | NO | NO | NO | YES | NO | NO | NO | NO |
| 1,2-Propanediol | YES | NO | NO | NO | NO | NO | NO | NO | NO | NO | NO | NO | NO | NO | YES | NO | NO |
| D-Fructose-6-Phosphate | NO | NO | NO | NO | YES | NO | YES | NO | YES | NO | NO | NO | NO | NO | NO | NO | NO |
| D-Threonine | YES | NO | NO | NO | NO | NO | NO | NO | NO | NO | NO | NO | NO | NO | NO | NO | NO |
| L-Threonine | YES | NO | NO | NO | NO | NO | NO | NO | NO | NO | NO | NO | YES | NO | YES | NO | NO |
| Tyramine | NO | YES | YES | NO | NO | NO | NO | NO | NO | NO | NO | NO | YES | NO | NO | NO | NO |
| Succinic acid | NO | NO | NO | NO | NO | NO | NO | NO | NO | NO | NO | NO | NO | NO | NO | NO | NO |
| D-Glucuronic acid | NO | NO | NO | NO | YES | NO | NO | NO | NO | NO | NO | NO | NO | NO | NO | NO | NO |
| Tween 20 | YES | NO | NO | NO | NO | NO | NO | NO | NO | NO | YES | NO | NO | NO | YES | YES | NO |
| Tween 40 | YES | NO | NO | YES | NO | NO | NO | NO | NO | NO | NO | NO | NO | NO | YES | NO | NO |
| Tween 80 | YES | NO | NO | NO | NO | NO | NO | NO | NO | NO | NO | NO | YES | NO | YES | NO | NO |
| Fumaric acid | YES | YES | NO | NO | NO | NO | NO | NO | NO | NO | NO | NO | NO | NO | YES | NO | NO |
| L-Alanine | YES | YES | YES | YES | YES | NO | NO | YES | YES | NO | NO | NO | YES | NO | YES | NO | NO |
| D-Psicose | NO | NO | NO | YES | NO | NO | NO | NO | NO | NO | NO | NO | NO | NO | NO | NO | NO |
| D-Galactose | YES | YES | NO | YES | YES | NO | YES | YES | NO | NO | YES | NO | NO | NO | NO | YES | NO |
| D-Gluconic acid | YES | YES | NO | YES | YES | NO | YES | NO | YES | NO | YES | NO | YES | NO | YES | NO | NO |
| L-Rhamnose | YES | YES | NO | YES | YES | NO | YES | YES | YES | NO | YES | NO | NO | YES | NO | YES | YES |
| a-Keto-Glutaric acid | NO | YES | NO | NO | YES | NO | NO | NO | YES | YES | YES | YES | YES | NO | YES | NO | NO |
| a-Hydroxy Glutaric acid-?-lactone | NO | NO | NO | NO | YES | NO | NO | NO | NO | NO | NO | YES | NO | NO | YES | NO | NO |
| Bromo succinic acid | NO | YES | NO | NO | NO | NO | NO | NO | NO | NO | NO | NO | YES | NO | YES | NO | NO |
| L-Alanyl-Glycine | YES | YES | YES | NO | YES | NO | NO | YES | NO | YES | YES | YES | YES | NO | YES | NO | NO |
| L-Lyxose | NO | NO | NO | YES | YES | NO | YES | NO | NO | NO | NO | NO | NO | NO | NO | NO | NO |
| L-Aspartic acid | NO | YES | NO | NO | YES | NO | YES | YES | NO | NO | YES | YES | YES | NO | YES | NO | NO |
| D-L-a-Glycerol phosphate | NO | NO | NO | NO | NO | NO | NO | NO | NO | NO | NO | NO | NO | YES | NO | NO | NO |
| D-Fructose | YES | YES | NO | YES | YES | NO | NO | YES | YES | NO | YES | NO | YES | NO | NO | NO | NO |
| a-Keto-Butyric acid | NO | NO | NO | NO | NO | NO | NO | NO | NO | NO | NO | NO | NO | NO | NO | NO | NO |
| a-Hydroxy Butyric acid | YES | NO | NO | NO | NO | NO | NO | NO | NO | NO | NO | NO | NO | YES | NO | NO | NO |
| Propionic acid | YES | YES | YES | NO | NO | NO | NO | NO | NO | NO | NO | YES | NO | YES | NO | NO | NO |
| Acetoacetic acid | YES | YES | NO | NO | NO | NO | NO | NO | NO | NO | NO | NO | YES | NO | YES | NO | NO |
| Glucuronamide | YES | NO | NO | NO | NO | NO | NO | NO | NO | NO | NO | NO | NO | NO | NO | NO | NO |
| L-Proline | NO | YES | NO | NO | NO | NO | NO | NO | NO | YES | NO | YES | NO | NO | YES | NO | NO |
| D-Xylose | YES | YES | YES | YES | YES | NO | NO | NO | YES | NO | YES | NO | YES | NO | YES | NO | NO |
| Acetic acid | YES | YES | NO | YES | NO | NO | NO | YES | NO | NO | YES | YES | YES | NO | YES | YES | NO |
| a-Methyl-D-Galactoside | YES | YES | NO | NO | YES | NO | NO | NO | YES | NO | YES | NO | NO | NO | NO | NO | NO |
| β-Methyl-D-glucoside | YES | YES | NO | YES | YES | NO | YES | YES | YES | YES | NO | YES | NO | YES | NO | NO | NO |
| Mucic acid | NO | YES | YES | YES | YES | NO | YES | YES | YES | NO | NO | YES | YES | NO | YES | YES | NO |
| N-acetyl-β-D-Mannosamine | YES | YES | NO | NO | YES | NO | NO | NO | YES | NO | YES | NO | NO | NO | YES | NO | YES |
| Pyruvic acid | YES | YES | YES | YES | YES | NO | YES | NO | NO | NO | YES | NO | YES | NO | YES | NO | NO |
| D-Alanine | YES | NO | NO | NO | NO | NO | NO | NO | NO | NO | NO | NO | NO | NO | NO | YES | NO |
| L-Lactic acid | NO | YES | NO | YES | YES | NO | NO | NO | YES | NO | NO | YES | NO | YES | NO | NO | NO |
| a-D-Glucose | YES | YES | NO | YES | YES | NO | NO | NO | NO | NO | YES | NO | YES | NO | NO | YES | YES |
| a-D-Lactose | YES | YES | NO | NO | NO | NO | NO | YES | NO | NO | YES | NO | NO | NO | NO | NO | NO |
| Adonitol | NO | NO | NO | NO | NO | NO | NO | NO | NO | NO | NO | NO | NO | NO | NO | NO | NO |
| Glycolic acid | NO | NO | NO | NO | NO | NO | NO | NO | NO | NO | NO | NO | NO | NO | YES | NO | NO |
| Mono Methyl Succinate | YES | YES | NO | NO | NO | NO | NO | NO | NO | NO | YES | NO | NO | NO | YES | NO | NO |
| L-Galactonic-acid-?-lactone | YES | YES | YES | YES | YES | NO | YES | YES | YES | YES | NO | YES | NO | NO | YES | NO | NO |
| D-Trehalose | YES | YES | NO | YES | YES | NO | NO | NO | YES | NO | YES | NO | NO | NO | NO | NO | NO |
| Formic acid | NO | YES | NO | YES | NO | NO | NO | NO | NO | NO | YES | NO | YES | NO | YES | YES | NO |
| Maltose | YES | YES | NO | YES | YES | NO | YES | YES | YES | NO | YES | NO | YES | YES | YES | NO | YES |
| Lactulose | YES | YES | NO | NO | NO | NO | NO | YES | NO | NO | YES | NO | NO | NO | NO | NO | NO |
| Maltotriose | YES | YES | NO | YES | YES | NO | YES | YES | YES | YES | YES | NO | YES | YES | YES | NO | YES |
| Glyoxylic acid | NO | YES | YES | NO | NO | NO | NO | NO | NO | NO | NO | NO | NO | NO | YES | NO | NO |
| Methyl Pyruvate | YES | YES | NO | NO | YES | NO | YES | NO | YES | YES | NO | YES | NO | YES | NO | NO | NO |
| D-Galacturonic acid | NO | YES | NO | YES | NO | NO | NO | YES | NO | NO | NO | YES | NO | NO | YES | NO | NO |
| D-Mannose | NO | YES | NO | YES | NO | NO | NO | YES | YES | NO | YES | NO | YES | NO | NO | NO | NO |
| D-Mannitol | YES | YES | NO | YES | YES | NO | NO | NO | NO | NO | YES | NO | NO | YES | NO | NO | NO |
| D-Melibiose | YES | YES | NO | YES | YES | NO | NO | YES | YES | NO | NO | NO | NO | NO | NO | NO | YES |
| Sucrose | YES | YES | NO | YES | YES | NO | NO | YES | YES | NO | YES | YES | NO | NO | NO | NO | NO |

TABLE 36C-continued

Substrate utilization as determined by BIOLOG PM1 MicroPlates by culturable bacteria belonging to core OTUs.

| Substrate | | | | | | | | | | | | | | | | | |
|---|---|---|---|---|---|---|---|---|---|---|---|---|---|---|---|---|---|
| 2-Deoxy adenosine | NO | YES | NO | YES | YES | NO | YES | NO | YES | NO | NO | NO | YES | NO | YES | NO | NO |
| D-Cellobiose | YES | YES | NO | YES | YES | NO | YES | YES | YES | NO | YES | NO | YES | YES | YES | NO | YES |
| D-Malic acid | NO | YES | NO | NO | NO | NO | NO | NO | NO | NO | NO | NO | NO | NO | YES | NO | NO |
| Phenylethylamine | NO | NO | NO | NO | NO | NO | NO | NO | NO | NO | NO | NO | NO | NO | NO | NO | NO |
| Dulcitol | YES | NO | NO | YES | NO | NO | NO | NO | NO | NO | NO | NO | NO | NO | NO | NO | YES |
| L-Glutamic acid | NO | NO | NO | NO | YES | NO | NO | NO | NO | NO | NO | NO | NO | NO | NO | NO | NO |
| Thymidine | YES | YES | NO | YES | YES | NO | YES | NO | YES | NO | YES | NO | YES | NO | YES | NO | NO |
| Uridine | YES | YES | YES | NO | YES | NO | YES | YES | YES | NO | YES | YES | YES | NO | YES | NO | NO |
| Adenosine | YES | YES | YES | YES | NO | NO | YES | NO | NO | NO | YES | NO | NO | NO | YES | NO | NO |
| Inosine | NO | YES | NO | NO | NO | NO | NO | NO | NO | YES | YES | NO | YES | NO | NO | NO | NO |
| L-Malic acid | NO | YES | NO | NO | NO | NO | NO | NO | NO | NO | NO | NO | YES | NO | YES | NO | NO |
| 2-Aminoethanol | NO | NO | NO | NO | NO | NO | NO | NO | NO | NO | YES | YES | NO | NO | YES | NO | NO |

| | Strain | | | | | | | | | | | | | | | | |
|---|---|---|---|---|---|---|---|---|---|---|---|---|---|---|---|---|---|
| Substrate | SYM 620 | SYM 627 | SYM 628 | SYM 62C | SYM 650 | SYM 68 | SYM 70 | SYM 714 | SYM 9 | SYM 905 | SYM 924 | SYM 963 | SYM 978 | SYM 982 | SYM 987 | SYM 991 | SYM 999 |
| D-Serine | NO | NO | YES | NO | NO | NO | NO | NO | NO | NO | NO | NO | YES | NO | NO | YES | NO |
| D-Glucose-6-Phosphate | YES | YES | YES | NO | NO | NO | NO | YES | NO | NO | NO | NO | NO | NO | NO | YES | NO |
| L-Asparagine | NO | NO | NO | NO | NO | NO | NO | NO | NO | NO | NO | NO | NO | NO | NO | NO | NO |
| L-glutamine | NO | NO | NO | NO | NO | NO | NO | NO | NO | NO | NO | NO | NO | NO | NO | NO | NO |
| Glycyl-L-Aspartic acid | NO | NO | NO | NO | YES | NO | NO | NO | NO | NO | NO | NO | NO | NO | NO | NO | NO |
| Glycyl-L-Glutamic acid | NO | NO | NO | NO | NO | YES | NO | NO | NO | NO | NO | NO | NO | NO | NO | NO | NO |
| Glycyl-L-Proline | NO | NO | NO | NO | NO | YES | NO | NO | NO | YES | NO | NO | NO | NO | NO | NO | NO |
| L-Arabinose | NO | NO | YES | NO | YES | YES | YES | YES | YES | NO | NO | NO | NO | NO | YES | NO | YES |
| D-Sorbitol | NO | NO | NO | NO | NO | NO | NO | YES | NO | NO | NO | NO | NO | NO | NO | NO | NO |
| D-Galactonic acid-?-lactone | NO | YES | YES | NO | NO | NO | NO | YES | NO | NO | NO | NO | NO | NO | NO | NO | NO |
| D-Aspartic acid | NO | NO | NO | NO | NO | NO | NO | NO | NO | NO | NO | NO | NO | NO | NO | NO | NO |
| m-Tartaric acid | NO | NO | NO | NO | NO | NO | NO | NO | NO | NO | NO | NO | NO | NO | NO | NO | NO |
| Citric acid | NO | NO | NO | NO | NO | YES | NO | NO | NO | NO | NO | NO | NO | NO | NO | NO | NO |
| Tricarballylic acid | NO | NO | NO | NO | NO | NO | NO | NO | NO | NO | NO | NO | NO | NO | NO | NO | NO |
| p-Hydroxy Phenyl acetic acid | NO | NO | NO | NO | NO | NO | NO | NO | NO | NO | NO | NO | NO | NO | YES | NO | NO |
| N-Acetyl-D-Glucosamine | NO | YES | YES | NO | NO | NO | YES | YES | NO | NO | NO | NO | NO | NO | YES | NO | NO |
| Glycerol | NO | NO | NO | NO | NO | NO | YES | YES | NO | NO | NO | NO | NO | NO | NO | NO | NO |
| D-L-Malic acid | NO | NO | NO | NO | NO | YES | YES | YES | NO | NO | NO | NO | NO | YES | NO | NO | NO |
| D-Glucosaminic acid | NO | NO | NO | NO | NO | NO | NO | NO | YES | NO | NO | NO | NO | NO | NO | NO | NO |
| D-Glucose-1-Phosphate | NO | NO | NO | NO | NO | NO | YES | NO | NO | NO | NO | NO | NO | NO | NO | NO | NO |
| m-Inositol | NO | NO | YES | NO | NO | NO | YES | NO | NO | NO | NO | NO | NO | NO | NO | NO | NO |
| L-Serine | NO | NO | NO | NO | NO | NO | YES | NO | NO | NO | NO | NO | NO | NO | NO | NO | NO |
| m-Hydroxy Phenyl Acetic acid | YES | NO | YES | NO | NO | NO | NO | NO | NO | NO | NO | NO | NO | NO | NO | NO | NO |
| D-Saccharic acid | NO | NO | NO | NO | NO | NO | YES | YES | NO | NO | NO | NO | NO | NO | YES | NO | YES |
| L-Fucose | NO | NO | YES | NO | NO | NO | YES | YES | NO | NO | NO | YES | YES | NO | NO | NO | NO |
| D-Ribose | NO | NO | NO | NO | NO | YES | YES | NO | NO | NO | NO | NO | NO | NO | NO | NO | NO |
| 1,2-Propanediol | NO | NO | NO | NO | NO | NO | NO | NO | NO | NO | NO | NO | NO | NO | NO | NO | NO |
| D-Fructose-6-Phosphate | YES | YES | YES | NO | NO | YES | YES | NO | NO | YES | NO | NO | NO | NO | NO | YES | NO |
| D-Threonine | NO | NO | NO | NO | NO | NO | NO | NO | NO | NO | NO | NO | NO | NO | NO | NO | NO |
| L-Threonine | NO | NO | NO | NO | NO | NO | NO | NO | NO | NO | NO | NO | NO | NO | NO | NO | NO |
| Tyramine | NO | NO | NO | NO | YES | YES | NO | NO | NO | NO | NO | NO | NO | NO | NO | NO | NO |
| Succinic acid | NO | NO | NO | NO | NO | NO | NO | NO | NO | NO | NO | NO | NO | NO | NO | NO | NO |
| D-Glucuronic acid | NO | NO | NO | NO | NO | NO | NO | NO | NO | NO | NO | NO | NO | NO | NO | NO | NO |
| Tween 20 | NO | NO | NO | NO | NO | NO | NO | NO | NO | NO | NO | NO | NO | NO | NO | NO | NO |
| Tween 40 | NO | NO | NO | NO | NO | NO | NO | NO | NO | NO | NO | NO | NO | NO | NO | NO | NO |
| Tween 80 | NO | NO | NO | NO | NO | NO | NO | YES | YES | NO | YES | YES | NO | NO | YES | NO | NO |
| Fumaric acid | NO | NO | NO | NO | NO | NO | NO | NO | NO | NO | NO | NO | NO | NO | NO | NO | NO |
| L-Alanine | YES | NO | YES | NO | YES | YES | YES | NO | YES | NO | NO | NO | NO | NO | NO | NO | NO |
| D-Psicose | NO | NO | NO | NO | NO | NO | YES | NO | NO | NO | NO | NO | NO | NO | NO | NO | NO |
| D-Galactose | NO | NO | YES | NO | NO | YES | NO | NO | NO | NO | NO | NO | NO | NO | NO | NO | NO |

TABLE 36C-continued

Substrate utilization as determined by BIOLOG PM1 MicroPlates by culturable bacteria belonging to core OTUs.

| Substrate | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| D-Gluconic acid | YES | YES | NO | NO | NO | NO | YES | NO | NO | NO | NO | NO | NO | NO | NO | NO | NO |
| L-Rhamnose | YES | YES | YES | NO | YES | YES | YES | NO | NO | NO | NO | NO | NO | NO | NO | NO | NO |
| a-Keto-Glutaric acid | NO | NO | NO | NO | YES | YES | YES | NO | NO | NO | NO | NO | NO | YES | NO | NO | NO |
| a-Hydroxy Glutaric acid-?-lactone | NO | NO | NO | NO | YES | YES | YES | NO | NO | NO | NO | NO | NO | NO | NO | NO | NO |
| Bromo succinic acid | NO | NO | NO | NO | NO | NO | NO | NO | NO | NO | NO | NO | NO | NO | NO | NO | NO |
| L-Alanyl-Glycine | NO | NO | NO | NO | YES | YES | NO | NO | NO | NO | NO | NO | NO | NO | NO | NO | NO |
| L-Lyxose | NO | NO | NO | NO | YES | YES | YES | NO | NO | NO | NO | NO | NO | NO | NO | NO | NO |
| L-Aspartic acid | NO | NO | NO | NO | NO | YES | YES | NO | NO | YES | NO | NO | NO | NO | NO | NO | NO |
| D-L-a-Glycerol phosphate | NO | NO | NO | NO | NO | NO | NO | NO | NO | NO | NO | NO | NO | NO | NO | NO | NO |
| D-Fructose | NO | NO | NO | NO | YES | YES | YES | NO | NO | NO | NO | NO | NO | NO | NO | NO | NO |
| a-Keto-Butyric acid | NO | NO | NO | NO | NO | NO | NO | NO | NO | NO | NO | NO | NO | NO | NO | NO | NO |
| a-Hydroxy Butyric acid | NO | NO | NO | NO | NO | NO | NO | NO | NO | NO | NO | NO | NO | NO | NO | NO | NO |
| Propionic acid | NO | NO | NO | NO | YES | NO | YES | NO | NO | NO | YES | YES | NO | NO | NO | NO | NO |
| Acetoacetic acid | NO | NO | NO | NO | NO | NO | NO | NO | NO | NO | NO | NO | NO | NO | NO | NO | NO |
| Glucuronamide | NO | NO | NO | NO | NO | NO | NO | NO | NO | NO | NO | NO | NO | NO | NO | NO | NO |
| L-Proline | NO | NO | YES | NO | YES | YES | NO | NO | NO | NO | NO | NO | NO | NO | NO | NO | NO |
| D-Xylose | NO | YES | YES | NO | YES | YES | YES | YES | NO | NO | NO | NO | NO | NO | | | |
| Acetic acid | NO | NO | NO | NO | YES | YES | NO | NO | NO | NO | NO | NO | YES | NO | NO | NO | NO |
| a-Methyl-D-Galacto-side | YES | YES | YES | NO | NO | NO | YES | NO | NO | NO | YES | YES | NO | NO | NO | NO | NO |
| β-Methyl-D-glucoside | NO | YES | YES | NO | YES | YES | YES | NO | NO | NO | NO | NO | NO | NO | NO | NO | NO |
| Mucic acid | NO | YES | YES | NO | YES | YES | YES | YES | NO | NO | YES | YES | NO | NO | YES | NO | YES |
| N-acetyl-β-D-Mannosamine | NO | NO | YES | NO | NO | NO | NO | NO | NO | NO | NO | NO | YES | NO | NO | YES | NO |
| Pyruvic acid | NO | YES | NO | NO | YES | NO | NO | NO | NO | NO | NO | NO | NO | NO | NO | NO | NO |
| D-Alanine | NO | NO | YES | NO | NO | NO | YES | NO | NO | NO | NO | NO | NO | NO | NO | NO | NO |
| L-Lactic acid | NO | NO | NO | NO | NO | NO | NO | YES | NO | NO | NO | NO | NO | NO | YES | NO | NO |
| a-D-Glucose | NO | NO | NO | NO | YES | NO | YES | YES | NO | NO | NO | NO | NO | YES | YES | NO | NO |
| a-D-Lactose | NO | NO | NO | YES | NO | NO | NO | YES | NO | NO | NO | YES | NO | NO | NO | NO | NO |
| Adonitol | NO | NO | NO | NO | NO | NO | YES | YES | NO | NO | NO | NO | NO | NO | NO | NO | NO |
| Glycolic acid | NO | NO | NO | NO | NO | NO | NO | NO | NO | NO | NO | NO | NO | NO | NO | NO | NO |
| Mono Methyl Succinate | NO | NO | NO | NO | YES | NO | NO | NO | NO | NO | YES | NO | NO | NO | NO | NO | YES |
| L-Galactonic-acid-?-lactone | YES | YES | YES | NO | NO | YES | YES | YES | YES | NO | NO | NO | NO | YES | NO | NO | NO |
| D-Trehalose | NO | NO | NO | NO | YES | NO | NO | YES | NO | NO | NO | NO | NO | NO | NO | NO | NO |
| Formic acid | NO | YES | NO | NO | NO | NO | YES | YES | NO | NO | NO | NO | NO | NO | NO | NO | NO |
| Maltose | NO | YES | YES | YES | YES | NO | YES | YES | NO | YES | NO | YES | NO | NO | NO | YES | NO |
| Lactulose | NO | NO | NO | YES | NO | NO | NO | YES | NO | NO | NO | YES | NO | NO | YES | NO | NO |
| Maltotriose | NO | YES | YES | NO | NO | NO | YES | NO | NO | YES | NO | YES | NO | NO | NO | NO | NO |
| Glyoxylic acid | NO | NO | NO | NO | NO | NO | NO | NO | NO | NO | YES | NO | NO | NO | NO | NO | YES |
| Methyl Pyruvate | NO | NO | NO | NO | YES | NO | NO | NO | NO | NO | NO | YES | NO | NO | NO | NO | YES |
| D-Galacturonic acid | YES | NO | NO | NO | NO | NO | YES | NO | NO | NO | NO | NO | NO | NO | NO | NO | NO |
| D-Mannose | NO | NO | NO | NO | NO | NO | YES | NO | YES | NO | NO | NO | NO | NO | NO | NO | NO |
| D-Mannitol | NO | NO | NO | NO | NO | NO | YES | NO | NO | NO | NO | NO | NO | NO | NO | NO | NO |
| D-Melibiose | NO | YES | YES | YES | NO | NO | YES | YES | NO | NO | NO | NO | NO | NO | NO | NO | NO |
| Sucrose | NO | YES | NO | NO | NO | NO | NO | NO | NO | NO | NO | NO | NO | NO | YES | YES | NO |
| 2-Deoxy adenosine | YES | YES | YES | NO | NO | NO | YES | NO | NO | NO | YES | NO | NO | NO | NO | NO | NO |
| D-Cellobiose | NO | YES | YES | NO | NO | NO | NO | YES | NO | YES | NO | NO | NO | NO | NO | NO | NO |
| D-Malic acid | NO | NO | NO | NO | YES | YES | NO | NO | NO | NO | NO | YES | NO | NO | NO | NO | NO |
| Phenylethyl-amine | NO | NO | NO | NO | NO | NO | NO | NO | NO | NO | NO | NO | NO | NO | NO | NO | NO |
| Dulcitol | NO | YES | NO | YES | NO | NO | NO | NO | NO | NO | NO | YES | NO | NO | NO | NO | NO |
| L-Glutamic acid | NO | NO | NO | NO | NO | NO | NO | NO | NO | NO | NO | NO | NO | NO | NO | NO | NO |
| Thymidine | NO | YES | YES | YES | NO | NO | NO | NO | NO | NO | NO | YES | NO | NO | NO | NO | NO |
| Uridine | NO | NO | YES | NO | NO | NO | YES | NO | YES | NO | NO | NO | NO | NO | NO | NO | NO |
| Adenosine | YES | NO | YES | NO | NO | NO | NO | NO | NO | NO | NO | NO | NO | NO | NO | NO | NO |
| Inosine | NO | NO | NO | NO | NO | NO | NO | YES | NO | NO | NO | NO | NO | NO | NO | NO | NO |
| L-Malic acid | NO | NO | NO | NO | NO | NO | NO | YES | NO | NO | NO | NO | NO | NO | NO | NO | NO |
| 2-Aminoethanol | NO | NO | NO | NO | NO | NO | NO | NO | NO | NO | NO | NO | NO | NO | NO | NO | NO |

TABLE 36D

Substrate utilization as determined by BIOLOG PM2A MicroPlates by culturable bacteria belonging to core OTUs.

| Substrate | SYM103 | SYM1049 | SYM13 | SYM17A | SYM18 | SYM183 | SYM184 | SYM20 | SYM207 | SYM212 | SYM219 | SYM234 | SYM236 | SYM248 | SYM249 |
|---|---|---|---|---|---|---|---|---|---|---|---|---|---|---|---|
| N-acetyl-D-Galactosamine | NO | NO | NO | YES | NO | YES | YES | NO | NO | NO | NO | NO | NO | NO | NO |
| Gentiobiose | NO | NO | NO | YES | YES | YES | YES | YES | NO | YES | YES | YES | NO | YES | YES |
| D-Raffinose | NO | NO | NO | YES | YES | NO | NO | NO | NO | NO | YES | YES | NO | YES | YES |
| Capric acid | NO | NO | NO | NO | NO | NO | NO | NO | NO | NO | NO | NO | NO | NO | NO |
| D-lactic acid methyl ester | NO | NO | NO | NO | NO | NO | NO | NO | YES | NO | NO | NO | NO | NO | NO |
| Acetamide | NO | NO | NO | NO | NO | NO | NO | YES | YES | NO | NO | YES | NO | NO | NO |
| L-Ornithine | YES | NO | YES | YES | YES | NO | NO | NO | YES | NO | YES | NO | NO | NO | NO |
| Chondroitin sulfate C | NO | NO | NO | NO | NO | NO | NO | NO | NO | NO | NO | NO | NO | NO | NO |
| N-acetyl-neuraminic acid | NO | NO | NO | NO | NO | NO | NO | NO | NO | NO | NO | YES | YES | YES | NO |
| L-glucose | NO | NO | NO | NO | NO | NO | NO | NO | NO | NO | NO | NO | NO | NO | YES |
| Salicin | NO | NO | NO | YES | NO | YES | YES | NO | NO | YES | YES | YES | NO | NO | NO |
| Caproic acid | NO | NO | NO | NO | NO | NO | NO | NO | NO | NO | NO | NO | NO | NO | NO |
| Malonic acid | NO | NO | YES | NO | NO | NO | NO | NO | NO | NO | NO | NO | NO | NO | YES |
| L-Alaninamide | NO | NO | YES | NO | NO | YES | YES | NO | YES | NO | NO | NO | YES | NO | NO |
| L-Phenylalanine | NO | NO | NO | NO | NO | NO | NO | NO | NO | NO | NO | NO | NO | NO | NO |
| α-Cyclodextrin | NO | NO | NO | NO | NO | NO | NO | NO | NO | YES | YES | YES | NO | NO | YES |
| β-D-allose | NO | NO | NO | YES | NO | YES | NO | NO | NO | NO | NO | NO | NO | NO | NO |
| Lactitol | NO | NO | NO | NO | NO | YES | YES | NO | NO | NO | NO | YES | NO | YES | NO |
| Sedoheptulosan | NO | NO | YES | NO | NO | NO | NO | NO | NO | NO | NO | NO | NO | NO | NO |
| Citraconic acid | NO | NO | NO | NO | NO | YES | NO | NO | NO | NO | NO | NO | NO | NO | NO |
| Melibionic acid | NO | NO | NO | NO | NO | NO | NO | NO | NO | YES | YES | NO | NO | YES | NO |
| N-Acetyl-L-Glutamic acid | YES | NO | NO | NO | NO | NO | YES | NO | NO | NO | NO | YES | NO | NO | NO |
| L-Pyroglutamic acid | YES | NO | YES | YES | YES | NO | YES | YES | YES | YES | YES | YES | YES | NO | NO |
| β-Cyclodextrin | NO | NO | NO | NO | NO | NO | NO | NO | NO | NO | NO | NO | NO | NO | YES |
| Amygdalin | NO | NO | NO | NO | NO | YES | YES | NO | NO | NO | NO | YES | NO | YES | NO |
| D-Melezitose | NO | NO | NO | YES | NO | NO | YES | NO | NO | YES | NO | YES | NO | NO | YES |
| L-Sorbose | NO | NO | NO | NO | NO | NO | NO | NO | NO | YES | NO | NO | NO | NO | NO |
| Citramalic acid | NO | NO | NO | NO | NO | YES | NO | NO | NO | NO | NO | NO | NO | NO | NO |
| Oxalic acid | NO | NO | YES | NO | NO | NO | NO | NO | NO | NO | NO | NO | NO | NO | NO |
| L-Arginine | NO | NO | NO | YES | YES | YES | YES | YES | NO | YES | YES | YES | NO | YES | YES |
| L-Valine | YES | NO | YES | YES | NO | NO | YES | YES | NO | YES | YES | YES | NO | NO | NO |
| γ-Cyclodextrin | NO | NO | NO | NO | NO | NO | NO | NO | NO | NO | NO | NO | NO | NO | YES |
| D-arabinose | NO | NO | NO | YES | NO | YES | YES | YES | NO | YES | YES | YES | NO | NO | NO |
| Maltitol | NO | NO | NO | NO | NO | NO | YES | NO | NO | YES | NO | YES | NO | YES | YES |
| Stachyose | NO | NO | NO | YES | NO | YES | YES | NO | NO | YES | YES | YES | NO | YES | YES |
| D-Glucosamine | YES | YES | YES | YES | YES | YES | YES | YES | NO | YES | NO | YES | YES | YES | YES |
| Oxalomalic acid | YES | NO | YES | NO | NO | YES | YES | NO | NO | NO | NO | NO | YES | NO | YES |
| Glycine | NO | YES | NO | YES | YES | NO | NO | YES | NO | YES | NO | YES | NO | YES | YES |
| D,L-Carnitine | YES | YES | YES | YES | NO | NO | YES | NO | NO | YES | YES | YES | NO | YES | YES |
| Dextrin | NO | NO | NO | NO | NO | NO | YES | NO | NO | YES | YES | YES | NO | NO | NO |

TABLE 36D-continued

Substrate utilization as determined by BIOLOG PM2A MicroPlates by culturable bacteria belonging to core OTUs.

| Substrate | | | | | | | | | | |
|---|---|---|---|---|---|---|---|---|---|---|
| D-arabitol | NO | NO | NO | NO | NO | NO | NO | NO | NO | NO |
| a-Methyl-D-Glucoside | NO | NO | NO | NO | NO | YES | NO | YES | NO | YES |
| D-Tagatose | NO | NO | NO | NO | NO | NO | NO | NO | NO | YES |
| 2-Hydroxy benzoic acid | NO | NO | NO | NO | NO | NO | NO | NO | NO | NO |
| Quinic acid | NO | YES | NO | NO | NO | NO | NO | NO | NO | NO |
| L-Histidine | NO | NO | NO | NO | NO | NO | NO | NO | NO | NO |
| Sec-Butylamine | NO | NO | NO | NO | NO | NO | NO | NO | NO | YES |
| Gelatin | NO | NO | YES | NO | NO | NO | NO | NO | NO | NO |
| L-arabitol | NO | NO | NO | NO | NO | YES | NO | NO | NO | NO |
| β-Methyl-D-Galactoside | NO | NO | YES | NO | YES | NO | YES | NO | NO | NO |
| Turanose | NO | YES | YES | NO | YES | YES | YES | NO | NO | YES |
| 4-Hydroxy benzoic acid | NO | NO | NO | NO | NO | YES | NO | NO | NO | NO |
| D-Ribono-1,4-Lactone | NO | NO | YES | NO | NO | NO | NO | NO | NO | NO |
| L-Homoserine | NO | NO | NO | NO | NO | NO | NO | NO | NO | NO |
| D,L-Octopamine | YES | NO | NO | NO | YES | NO | YES | NO | YES | NO |
| Glycogen | NO | NO | YES | NO | NO | NO | NO | NO | NO | YES |
| Arbutin | NO | NO | NO | YES | YES | NO | YES | NO | NO | NO |
| 3-Methyl Glucose | NO | NO | YES | NO | NO | NO | NO | NO | NO | NO |
| Xylitol | NO | NO | NO | NO | NO | NO | YES | NO | NO | NO |
| β-Hydroxy butyric acid | NO | NO | NO | NO | NO | NO | NO | YES | NO | NO |
| Sebacic acid | YES | NO | NO | NO | NO | NO | NO | NO | NO | NO |
| Hydroxy-L-Proline | NO | NO | YES | NO | NO | NO | NO | NO | YES | NO |
| Putrescine | YES | NO | YES | NO | NO | NO | NO | YES | YES | NO |
| Inulin | NO | NO | NO | NO | YES | NO | YES | NO | NO | NO |
| 2-Deoxy-D-Ribose | NO | YES | NO | NO | NO | NO | NO | NO | NO | NO |
| β-Methyl-D-Glucuronic acid | NO | NO | NO | NO | NO | NO | NO | NO | NO | NO |
| N-Acetyl-D-glucosaminitol | NO | YES | NO | NO | YES | NO | NO | YES | NO | NO |
| γ-Hydroxy butyric acid | NO | NO | NO | NO | NO | NO | NO | YES | NO | NO |
| Sorbic acid | NO | NO | NO | NO | NO | NO | YES | NO | NO | NO |
| L-Isoleucine | YES | YES | NO | YES | NO | YES | NO | NO | NO | NO |
| Dihydroxy acetone | NO | NO | NO | NO | NO | NO | YES | NO | NO | NO |
| Laminarin | NO | YES | NO | NO | NO | NO | NO | NO | NO | NO |
| i-Erythritol | NO | NO | NO | NO | YES | NO | NO | NO | NO | NO |
| a-Methyl-D-Mannoside | YES | NO | YES | NO | NO | NO | YES | NO | NO | NO |
| γ-amino butyric acid | NO | NO | NO | NO | NO | NO | NO | NO | NO | NO |
| a-Keto-valeric acid | YES | NO | NO | NO | YES | NO | NO | NO | NO | YES |
| Succinamic acid | NO | YES | NO | NO | NO | YES | NO | NO | NO | NO |
| L-Leucine | YES | NO | YES | YES | YES | NO | YES | NO | NO | NO |
| 2,3-Butanediol | NO | YES | YES | NO | NO | NO | NO | NO | NO | NO |
| Mannan | NO | NO | YES | NO | NO | NO | YES | NO | NO | NO |
| D-Fucose | NO | NO | NO | NO | NO | NO | NO | NO | NO | NO |
| β-Methyl-D-Xyloside | NO | NO | YES | NO | YES | NO | YES | NO | YES | YES |
| d-amino valeric acid | NO | NO | NO | NO | NO | NO | NO | NO | NO | NO |
| Itaconic acid | NO | NO | NO | NO | YES | NO | NO | NO | NO | NO |
| D-Tartaric acid | NO | NO | NO | NO | NO | NO | NO | NO | NO | NO |
| L-Lysine | NO | NO | NO | NO | NO | NO | NO | NO | NO | NO |

TABLE 36D-continued

Substrate utilization as determined by BIOLOG PM2A MicroPlates by culturable bacteria belonging to core OTUs.

| Substrate | SYM 260 | SYM 290 | SYM 292 | SYM3 | SYM43 | SYM50 | SYM 5066 | SYM 508 | SYM 525 | SYM53 | SYM 538A | SYM 538B | SYM 538i | SYM 543 | SYM 563 | SYM 574 |
|---|---|---|---|---|---|---|---|---|---|---|---|---|---|---|---|---|
| 2,3-Butanone | NO | NO | NO | NO | NO | NO | NO | NO | NO | NO | NO | NO | NO | NO | NO | NO |
| Pectin | NO | NO | NO | NO | NO | NO | NO | NO | NO | NO | NO | YES | YES | NO | NO | NO |
| 3-O-β-D-Galactopyranosyl-D-arabinose | NO | NO | NO | NO | NO | NO | NO | NO | NO | NO | NO | YES | YES | NO | NO | NO |
| Palatinose | NO | NO | NO | YES | NO | YES | YES | NO | NO | YES | YES | NO | YES | NO | NO | NO |
| Butyric acid | NO | NO | NO | NO | NO | NO | NO | NO | NO | NO | NO | NO | NO | NO | NO | NO |
| 5-Keto-D-Gluconic acid | NO | NO | NO | NO | YES | NO | NO | YES | NO | YES | NO | NO | NO | NO | NO | NO |
| L-Tartaric acid | YES | NO | YES | NO | YES | NO | NO | YES | NO | NO | NO | NO | NO | NO | NO | NO |
| L-Methionine | NO | NO | NO | NO | NO | NO | NO | NO | NO | NO | NO | NO | NO | NO | NO | NO |
| 3-Hydroxy 2-Butanone | NO | NO | NO | NO | NO | NO | NO | NO | NO | NO | NO | NO | NO | NO | NO | NO |

| Substrate | SYM 260 | SYM 290 | SYM 292 | SYM3 | SYM43 | SYM50 | SYM 5066 | SYM 508 | SYM 525 | SYM53 | SYM 538A | SYM 538B | SYM 538i | SYM 543 | SYM 563 | SYM 574 |
|---|---|---|---|---|---|---|---|---|---|---|---|---|---|---|---|---|
| N-acetyl-D-Galactosamine | NO | NO | NO | NO | NO | YES | NO | NO | NO | YES | NO | NO | NO | NO | NO | NO |
| Gentiobiose | YES | YES | YES | NO | YES | YES | NO | YES | YES | YES | NO | YES | YES | NO | YES | NO |
| D-Raffinose | YES | YES | YES | NO | NO | YES | NO | NO | NO | YES | NO | YES | NO | NO | NO | NO |
| Capric acid | NO | NO | NO | NO | NO | NO | NO | NO | NO | YES | NO | NO | NO | NO | NO | NO |
| D-lactic acid methyl ester | NO | NO | NO | NO | NO | YES | NO | NO | NO | YES | NO | NO | NO | NO | NO | NO |
| Acetamide | NO | NO | NO | NO | NO | NO | NO | NO | NO | NO | NO | NO | NO | NO | NO | YES |
| L-Ornithine | YES | NO | NO | YES | NO | YES | NO | NO | YES | NO | NO | NO | NO | NO | NO | NO |
| Chondroitin sulfate C | YES | NO | NO | NO | NO | NO | NO | NO | NO | NO | NO | NO | NO | NO | NO | NO |
| N-acetyl-neuraminic acid | NO | NO | NO | NO | NO | NO | NO | NO | NO | NO | NO | NO | NO | NO | NO | NO |
| L-glucose | NO | NO | NO | NO | NO | NO | NO | NO | YES | NO | NO | NO | NO | NO | NO | NO |
| Salicin | YES | YES | YES | NO | NO | YES | NO | YES | YES | YES | NO | YES | YES | NO | YES | NO |
| Caproic acid | YES | NO | YES | NO | NO | NO | NO | YES | NO | NO | NO | NO | NO | NO | NO | NO |
| Malonic acid | YES | NO | NO | NO | NO | NO | NO | YES | YES | NO | NO | NO | NO | NO | NO | NO |
| L-Alaninamide | NO | YES | NO | NO | NO | NO | NO | NO | NO | NO | YES | NO | YES | NO | NO | YES |
| L-Phenylalanine | YES | NO | YES | YES | NO | NO | NO | NO | YES | NO | NO | NO | NO | NO | NO | YES |
| α-Cyclodextrin | NO | NO | NO | NO | NO | NO | NO | NO | YES | NO | NO | NO | YES | NO | NO | YES |
| β-D-allose | YES | YES | YES | NO | NO | NO | NO | NO | NO | YES | YES | NO | NO | NO | NO | NO |
| Lactitol | NO | NO | NO | NO | NO | NO | NO | NO | NO | NO | NO | YES | NO | NO | NO | NO |
| Sedoheptulosan | YES | YES | YES | NO | NO | NO | NO | NO | YES | NO | NO | NO | YES | NO | NO | NO |
| Citraconic acid | NO | NO | NO | NO | NO | NO | NO | NO | NO | NO | NO | NO | NO | NO | NO | NO |
| Melibionic acid | YES | YES | NO | NO | NO | YES | NO | NO | YES | YES | NO | NO | NO | NO | NO | NO |
| N-Acetyl-L-Glutamic acid | NO | NO | NO | NO | NO | NO | NO | NO | NO | NO | NO | NO | NO | NO | NO | NO |
| L-Pyroglutamic acid | YES | YES | YES | NO | NO | NO | NO | YES | YES | NO | YES | NO | YES | YES | NO | YES |
| β-Cyclodextrin | NO | NO | NO | NO | NO | NO | NO | NO | NO | NO | NO | YES | NO | NO | NO | NO |
| Amygdalin | NO | YES | YES | NO | NO | NO | NO | NO | YES | NO | NO | YES | YES | NO | NO | NO |
| D-Melezitose | YES | YES | YES | YES | NO | NO | NO | NO | YES | NO | YES | YES | YES | YES | YES | NO |
| L-Sorbose | NO | NO | NO | NO | NO | NO | NO | NO | NO | NO | NO | NO | NO | NO | NO | NO |
| Citramalic acid | YES | YES | YES | NO | NO | NO | NO | NO | YES | NO | NO | NO | NO | NO | YES | NO |
| Oxalic acid | NO | NO | NO | NO | NO | NO | NO | NO | NO | NO | NO | NO | NO | NO | NO | NO |
| L-Arginine | YES | NO | NO | NO | NO | NO | NO | NO | NO | NO | NO | NO | NO | YES | NO | YES |

TABLE 36D-continued

Substrate utilization as determined by BIOLOG PM2A MicroPlates by culturable bacteria belonging to core OTUs.

| Substrate | 1 | 2 | 3 | 4 | 5 | 6 | 7 | 8 | 9 | 10 |
|---|---|---|---|---|---|---|---|---|---|---|
| L-Valine | YES | NO | YES | NO | NO | NO | NO | NO | NO | NO |
| γ-Cyclodextrin | NO | YES | YES | NO | NO | NO | YES | NO | NO | NO |
| D-arabinose | NO | YES | NO | NO | NO | NO | NO | NO | NO | YES |
| Maltitol | YES | YES | YES | NO | NO | NO | YES | NO | NO | NO |
| Stachyose | YES | YES | NO | NO | NO | NO | YES | NO | NO | NO |
| D-Glucosamine | YES | YES | YES | YES | YES | YES | YES | YES | YES | NO |
| Oxalomalic acid | NO | NO | NO | YES | NO | NO | YES | YES | YES | YES |
| Glycine | NO | NO | NO | NO | NO | NO | NO | NO | NO | NO |
| D,L-Carnitine | YES | NO | YES | NO | NO | NO | YES | NO | NO | NO |
| Dextrin | YES | YES | NO | NO | NO | NO | NO | NO | NO | NO |
| D-arabitol | NO | NO | NO | NO | NO | NO | YES | NO | NO | NO |
| α-Methyl-D-Glucoside | YES | YES | NO | NO | NO | NO | NO | NO | NO | NO |
| D-Tagatose | YES | YES | NO | NO | NO | NO | YES | NO | NO | NO |
| 2-Hydroxy benzoic acid | NO | NO | NO | NO | NO | NO | NO | NO | NO | YES |
| Quinic acid | NO | NO | NO | YES | NO | NO | NO | NO | NO | NO |
| L-Histidine | YES | YES | NO | YES | NO | NO | NO | NO | NO | NO |
| Sec-Butylamine | NO | NO | NO | NO | NO | NO | NO | NO | NO | YES |
| Gelatin | YES | YES | NO | NO | NO | NO | YES | YES | NO | NO |
| L-arabitol | NO | NO | NO | NO | NO | NO | NO | NO | NO | YES |
| β-Methyl-D-Galactoside | NO | YES | NO | NO | YES | NO | NO | NO | NO | NO |
| Turanose | NO | YES | YES | NO | YES | NO | YES | NO | NO | NO |
| 4-Hydroxy benzoic acid | NO | NO | NO | NO | NO | NO | NO | NO | NO | YES |
| D-Ribono-1,4-Lactone | NO | NO | NO | NO | YES | NO | NO | NO | NO | YES |
| L-Homoserine | YES | NO | YES | NO | NO | NO | NO | NO | NO | YES |
| D,L-Octopamine | NO | NO | NO | NO | NO | YES | NO | NO | NO | NO |
| Glycogen | YES | YES | NO | NO | YES | YES | YES | YES | YES | NO |
| Arbutin | NO | YES | NO | YES | YES | YES | YES | YES | YES | NO |
| 3-Methyl Glucose | NO | NO | NO | YES | NO | NO | NO | NO | NO | NO |
| Xylitol | NO | YES | NO | YES | NO | NO | YES | NO | NO | NO |
| β-Hydroxy butyric acid | YES | YES | NO | YES | NO | NO | YES | NO | NO | YES |
| Sebacic acid | NO | NO | NO | NO | NO | NO | NO | NO | NO | YES |
| Hydroxy-L-Proline | YES | NO | YES | NO | NO | NO | NO | NO | NO | NO |
| Putrescine | YES | YES | YES | YES | YES | YES | YES | YES | YES | YES |
| Inulin | YES | YES | YES | NO | NO | NO | NO | NO | NO | NO |
| 2-Deoxy-D-Ribose | NO | YES | NO | NO | NO | NO | YES | NO | NO | NO |
| β-Methyl-D-Glucuronic acid | NO | NO | NO | NO | YES | NO | NO | NO | NO | NO |
| N-Acetyl-D-glucosaminitol | NO | NO | NO | NO | NO | NO | NO | NO | NO | YES |
| γ-Hydroxy butyric acid | YES | YES | NO | NO | YES | NO | NO | NO | NO | NO |
| Sorbic acid | NO | NO | NO | NO | NO | NO | NO | NO | NO | NO |
| L-Isoleucine | YES | YES | YES | NO | YES | YES | NO | YES | NO | YES |
| Dihydroxy acetone | NO | NO | YES | NO | YES | NO | NO | NO | NO | YES |
| Laminarin | NO | YES | NO | NO | NO | YES | NO | YES | NO | NO |
| i-Erythritol | NO | NO | NO | NO | NO | NO | NO | NO | NO | NO |
| α-Methyl-D-Mannoside | YES | NO | YES | YES | YES | NO | NO | NO | NO | YES |
| γ-amino butyric acid | YES | NO | YES | NO | NO | NO | NO | NO | NO | YES |
| α-Keto-valeric acid | YES | NO | NO | NO | NO | NO | NO | NO | NO | NO |

TABLE 36D-continued

Substrate utilization as determined by BIOLOG PM2A MicroPlates by culturable bacteria belonging to core OTUs.

Strain

| Substrate | SYM 57B | SYM 617 | SYM 620 | SYM 627 | SYM 628 | SYM 62C | SYM 650 | SYM 68 | SYM 70 | SYM 714 | SYM9 | SYM 905 | SYM 924 | SYM 963 | SYM 978 | SYM 982 | SYM 987 | SYM 991 | SYM 999 |
|---|---|---|---|---|---|---|---|---|---|---|---|---|---|---|---|---|---|---|---|
| Succinamic acid | NO | NO | NO | NO | YES | NO | NO | NO | NO | YES | NO | YES | NO | NO | NO | NO | NO | YES | NO |
| L-Leucine | NO | YES | YES | YES | YES | YES | NO | NO | NO | YES | NO | YES | NO | NO | NO | NO | NO | NO | NO |
| 2,3-Butanediol | YES | NO | NO | NO | NO | YES | NO | NO | NO | NO | NO | YES | NO | NO | NO | NO | NO | YES | NO |
| Mannan | NO | NO | NO | NO | NO | NO | NO | NO | NO | NO | NO | NO | NO | NO | NO | NO | NO | NO | NO |
| D-Fucose | NO | NO | NO | NO | NO | NO | NO | NO | NO | NO | NO | NO | NO | NO | NO | NO | NO | NO | NO |
| β-Methyl-D-Xyloside | NO | YES | YES | YES | NO | NO | NO | NO | NO | NO | NO | NO | NO | NO | NO | NO | NO | NO | NO |
| d-amino valeric acid | YES | NO | NO | NO | NO | NO | NO | NO | NO | NO | NO | YES | NO | NO | NO | NO | NO | NO | NO |
| Itaconic acid | YES | NO | YES | NO | NO | NO | NO | NO | NO | NO | NO | NO | NO | NO | NO | YES | NO | NO | YES |
| D-Tartaric acid | NO | NO | NO | NO | NO | NO | NO | NO | YES | NO | NO | NO | NO | NO | NO | NO | NO | NO | NO |
| L-Lysine | YES | NO | NO | NO | NO | NO | NO | NO | NO | YES | NO | NO | NO | NO | NO | NO | NO | NO | NO |
| 2,3-Butanone | NO | YES | YES | NO | NO | NO | NO | NO | NO | NO | NO | YES | NO | NO | NO | NO | NO | NO | NO |
| Pectin | NO | YES | YES | YES | YES | NO | NO | YES | NO | NO | NO | YES | NO | NO | NO | NO | NO | NO | NO |
| 3-0-β-D-Galactopyranosyl-D-arabinose | NO | NO | YES | NO | NO | NO | NO | NO | NO | NO | NO | YES | NO | NO | NO | NO | NO | NO | NO |
| Palatinose | NO | YES | YES | YES | NO | NO | NO | NO | YES | NO | NO | YES | NO | NO | NO | NO | NO | NO | NO |
| Butyric acid | YES | NO | NO | NO | NO | NO | NO | NO | NO | NO | NO | NO | NO | NO | NO | NO | NO | NO | NO |
| 5-Keto-D-Gluconic acid | NO | NO | NO | NO | YES | NO | NO | YES | NO | NO | NO | NO | NO | NO | NO | NO | NO | NO | YES |
| L-Tartaric acid | NO | NO | NO | NO | YES | NO | NO | YES | NO | NO | NO | NO | NO | NO | NO | NO | NO | NO | YES |
| L-Methionine | NO | NO | NO | NO | NO | NO | NO | NO | NO | NO | NO | YES | NO | NO | NO | NO | NO | NO | NO |
| 3-Hydroxy 2-Butanone | NO | NO | NO | NO | NO | NO | NO | NO | NO | NO | NO | NO | NO | NO | NO | NO | NO | NO | NO |
| Substrate | SYM 57B | SYM 617 | SYM 620 | SYM 627 | SYM 628 | SYM 62C | SYM 650 | SYM 68 | SYM 70 | SYM 714 | SYM9 | SYM 905 | SYM 924 | SYM 963 | SYM 978 | SYM 982 | SYM 987 | SYM 991 | SYM 999 |
| N-acetyl-D-Galactosamine | NO | NO | NO | NO | YES | NO | NO | NO | NO | YES | NO | YES | NO | NO | NO | NO | NO | YES | NO |
| Gentiobiose | NO | YES | YES | YES | YES | YES | NO | NO | NO | YES | NO | YES | NO | NO | NO | NO | NO | NO | NO |
| D-Raffinose | NO | NO | YES | YES | YES | YES | NO | NO | NO | YES | NO | NO | NO | NO | NO | NO | NO | YES | NO |
| Caproic acid | NO | NO | NO | NO | NO | NO | NO | NO | NO | NO | NO | NO | NO | NO | NO | NO | NO | NO | NO |
| D-lactic acid methyl ester | NO | NO | NO | NO | NO | NO | NO | NO | NO | YES | NO | YES | NO | NO | NO | NO | NO | NO | NO |
| Acetamide | NO | NO | NO | NO | NO | NO | NO | NO | NO | NO | NO | NO | NO | NO | NO | NO | NO | NO | NO |
| L-Ornithine | NO | NO | NO | NO | NO | NO | NO | NO | YES | NO | YES | NO | NO | NO | NO | NO | NO | NO | NO |
| Chondrointin sulfate C | NO | NO | YES | NO | NO | NO | NO | NO | NO | NO | NO | NO | NO | NO | NO | NO | NO | NO | NO |
| N-acetyl-neuraminic acid | NO | NO | NO | NO | NO | NO | NO | NO | NO | NO | NO | NO | NO | NO | NO | NO | NO | NO | NO |
| L-glucose | NO | YES | NO | YES | YES | NO | NO | NO | NO | YES | NO | YES | NO | NO | NO | NO | NO | NO | NO |
| Salicin | NO | NO | NO | NO | NO | YES | NO | NO | NO | NO | NO | NO | NO | NO | NO | NO | NO | NO | NO |
| Caproic acid | NO | NO | NO | NO | NO | NO | NO | NO | NO | NO | NO | NO | NO | NO | NO | NO | NO | NO | NO |
| Malonic acid | NO | NO | NO | NO | YES | NO | NO | NO | NO | YES | NO | YES | YES | NO | NO | NO | NO | NO | NO |
| L-Alaninamide | NO | NO | NO | NO | NO | NO | NO | YES | NO | NO | NO | YES | NO | NO | NO | NO | NO | NO | NO |
| L-Phenylalanine | NO | NO | NO | NO | NO | NO | NO | NO | NO | NO | YES | NO | NO | NO | NO | NO | NO | NO | NO |
| α-Cyclodextrin | NO | NO | NO | NO | NO | NO | NO | NO | NO | NO | NO | YES | NO | NO | NO | YES | NO | NO | NO |
| β-D-allose | NO | NO | NO | NO | NO | NO | NO | NO | NO | YES | NO | NO | NO | NO | NO | NO | NO | NO | NO |
| Lactitol | NO | NO | NO | NO | NO | NO | NO | NO | NO | YES | NO | YES | NO | NO | NO | NO | NO | NO | NO |
| Sedoheptulosan | NO | NO | NO | NO | NO | NO | NO | NO | NO | NO | NO | NO | NO | NO | NO | NO | NO | NO | NO |
| Citraconic acid | NO | NO | YES | YES | YES | NO | NO | YES | NO | YES | YES | NO | YES | NO | YES | NO | NO | NO | NO |
| Melibionic acid | NO | NO | NO | NO | NO | NO | NO | YES | NO | YES | NO | NO | NO | NO | YES | NO | NO | NO | YES |
| N-Acetyl-L-Glutamic acid | NO | NO | NO | NO | NO | YES | NO | NO | NO | NO | NO | NO | NO | NO | NO | NO | YES | NO | NO |

TABLE 36D-continued

Substrate utilization as determined by BIOLOG PM2A MicroPlates by culturable bacteria belonging to core OTUs.

| Substrate | | | | | | | | | | | |
|---|---|---|---|---|---|---|---|---|---|---|---|
| L-Pyroglutamic acid | NO | NO | NO | NO | YES | NO | NO | NO | YES | NO | NO |
| β-Cyclodextrin | NO | NO | NO | NO | NO | NO | NO | YES | YES | NO | NO |
| Amygdalin | NO | YES | NO | YES | YES | NO | NO | NO | NO | NO | YES |
| D-Melezitose | NO | YES | NO | YES | NO | NO | NO | NO | YES | NO | NO |
| L-Sorbose | NO | NO | NO | NO | NO | NO | NO | NO | YES | NO | NO |
| Citramalic acid | NO | NO | NO | NO | NO | NO | NO | NO | YES | NO | NO |
| Oxalic acid | NO | NO | NO | NO | NO | NO | NO | NO | NO | NO | NO |
| L-Arginine | NO | NO | NO | NO | YES | NO | NO | NO | NO | NO | NO |
| L-Valine | NO | NO | NO | NO | NO | YES | NO | NO | NO | NO | NO |
| γ-Cyclodextrin | NO | NO | NO | NO | YES | NO | NO | NO | NO | NO | NO |
| D-arabinose | NO | NO | NO | YES | NO | YES | NO | NO | NO | NO | NO |
| Maltitol | NO | NO | YES | YES | NO | NO | YES | YES | YES | NO | NO |
| Stachyose | YES | NO | NO | NO | NO | NO | NO | NO | NO | NO | YES |
| D-Glucosamine | YES | YES | NO | YES | YES | YES | YES | NO | NO | YES | YES |
| Oxalomalic acid | YES | YES | NO | YES | YES | YES | YES | NO | NO | NO | NO |
| Glycine | NO | NO | NO | NO | NO | NO | NO | NO | NO | NO | NO |
| D,L-Carnitine | NO | NO | NO | NO | NO | NO | NO | NO | NO | NO | NO |
| Dextrin | YES | NO | YES | NO | NO | YES | NO | NO | NO | YES | NO |
| D-arabitol | NO | NO | NO | NO | NO | NO | NO | NO | NO | NO | NO |
| α-Methyl-D-Glucoside | NO | NO | NO | YES | YES | YES | NO | NO | NO | NO | NO |
| D-Tagatose | NO | NO | NO | NO | NO | NO | NO | NO | NO | NO | NO |
| 2-Hydroxy benzoic acid | NO | NO | NO | NO | NO | NO | NO | NO | NO | NO | NO |
| Quinic acid | NO | NO | NO | YES | YES | NO | NO | NO | NO | NO | NO |
| L-Histidine | YES | NO | YES | NO | NO | NO | NO | NO | NO | NO | NO |
| Sec-Butylamine | NO | NO | NO | NO | NO | NO | NO | NO | NO | NO | NO |
| Gelatin | NO | NO | NO | NO | YES | NO | YES | NO | NO | NO | NO |
| L-arabitol | NO | NO | NO | NO | NO | NO | NO | NO | NO | NO | NO |
| β-Methyl-D-Galactoside | NO | YES | YES | YES | NO | YES | NO | YES | YES | NO | NO |
| Turanose | NO | NO | YES | YES | NO | YES | NO | NO | NO | NO | NO |
| 4-Hydroxy benzoic acid | NO | NO | NO | NO | NO | NO | NO | NO | NO | NO | NO |
| D-Ribono-1,4-Lactone | NO | NO | NO | NO | NO | NO | NO | NO | YES | NO | NO |
| L-Homoserine | YES | NO | NO | NO | NO | NO | NO | NO | NO | NO | NO |
| D,L-Octopamine | NO | YES | NO | YES | NO | YES | NO | YES | NO | YES | YES |
| Glycogen | NO | NO | NO | NO | NO | NO | NO | NO | NO | NO | NO |
| Arbutin | NO | YES | YES | YES | YES | YES | YES | NO | NO | NO | NO |
| 3-Methyl Glucose | NO | NO | YES | YES | NO | NO | NO | NO | NO | NO | NO |
| Xylitol | YES | NO | NO | NO | NO | NO | NO | NO | NO | NO | NO |
| β-Hydroxy butyric acid | NO | NO | NO | NO | YES | YES | NO | NO | YES | NO | NO |
| Sebacic acid | YES | NO | NO | NO | NO | NO | NO | NO | NO | NO | NO |
| Hydroxy-L-Proline | NO | NO | YES | NO | NO | NO | NO | NO | NO | NO | NO |
| Putrescine | NO | NO | NO | YES | NO | YES | NO | NO | YES | YES | YES |
| Inulin | YES | NO | NO | NO | NO | NO | NO | NO | NO | NO | NO |
| 2-Deoxy-D-Ribose | NO | YES | NO | NO | NO | NO | NO | NO | YES | NO | YES |
| β-Methyl-D-Glucuronic acid | NO | NO | NO | NO | NO | NO | NO | NO | NO | NO | NO |
| N-Acetyl-D-glucosaminitol | NO | NO | NO | NO | NO | NO | NO | NO | NO | NO | NO |

TABLE 36D-continued

Substrate utilization as determined by BIOLOG PM2A MicroPlates by culturable bacteria belonging to core OTUs.

| Substrate | | | | | | | | | | | | | | | |
|---|---|---|---|---|---|---|---|---|---|---|---|---|---|---|---|
| γ-Hydroxy butyric acid | NO | NO | NO | NO | NO | NO | NO | NO | NO | NO | NO | NO | NO | NO | NO |
| Sorbic acid | NO | NO | NO | NO | NO | NO | NO | NO | NO | NO | NO | NO | NO | NO | NO |
| L-Isoleucine | NO | NO | NO | NO | NO | NO | NO | NO | NO | NO | NO | NO | NO | NO | NO |
| Dihydroxy acetone | YES | NO | YES | NO | YES | YES | YES | YES | NO | YES | YES | YES | NO | NO | NO |
| Laminarin | NO | NO | NO | NO | NO | NO | NO | NO | NO | NO | YES | NO | NO | NO | NO |
| i-Erythritol | NO | NO | NO | NO | NO | NO | NO | NO | NO | NO | NO | NO | NO | NO | NO |
| a-Methyl-D-Mannoside | NO | NO | NO | NO | NO | NO | NO | NO | NO | NO | NO | NO | NO | NO | NO |
| γ-amino butyric acid | YES | NO | NO | NO | NO | YES | YES | NO | NO | NO | NO | NO | NO | NO | NO |
| a-Keto-valeric acid | NO | NO | NO | NO | NO | NO | NO | NO | NO | NO | NO | NO | NO | NO | NO |
| Succinamic acid | NO | NO | NO | NO | NO | NO | NO | NO | YES | NO | NO | NO | NO | NO | NO |
| L-Leucine | YES | NO | NO | NO | NO | NO | YES | YES | NO | NO | NO | NO | NO | NO | NO |
| 2,3-Butanediol | NO | NO | NO | YES | NO | NO | NO | NO | NO | NO | NO | NO | NO | NO | NO |
| Mannan | NO | NO | NO | NO | NO | NO | NO | NO | NO | NO | NO | NO | NO | NO | NO |
| D-Fucose | NO | NO | NO | NO | NO | NO | YES | NO | NO | NO | NO | NO | NO | NO | NO |
| β-Methyl-D-Xyloside | NO | NO | NO | YES | NO | NO | YES | NO | NO | NO | NO | NO | NO | NO | NO |
| d-amino valeric acid | YES | NO | NO | NO | NO | NO | NO | NO | NO | NO | NO | NO | NO | NO | NO |
| Itaconic acid | NO | NO | NO | NO | NO | NO | NO | NO | NO | NO | NO | NO | NO | NO | NO |
| D-Tartaric acid | YES | NO | NO | NO | NO | NO | NO | NO | NO | NO | NO | NO | NO | NO | NO |
| L-Lysine | NO | NO | NO | NO | NO | NO | NO | NO | NO | NO | NO | NO | NO | NO | NO |
| 2,3-Butanone | NO | NO | NO | NO | NO | NO | NO | NO | NO | NO | NO | NO | NO | YES | NO |
| Pectin | NO | NO | NO | YES | NO | NO | NO | NO | NO | NO | NO | YES | NO | NO | NO |
| 3-O-β-D-Galactopyranosyl-D-arabinose | NO | NO | NO | NO | NO | NO | NO | NO | NO | NO | NO | NO | NO | NO | NO |
| Palatinose | NO | NO | YES | NO | YES | YES | NO | YES | YES | YES | YES | YES | NO | NO | NO |
| Butyric acid | NO | NO | NO | NO | NO | NO | NO | NO | NO | NO | NO | NO | NO | NO | NO |
| 5-Keto-D-Gluconic acid | NO | NO | NO | NO | NO | NO | NO | NO | NO | NO | NO | NO | NO | NO | NO |
| L-Tartaric acid | NO | NO | NO | NO | NO | YES | YES | NO | YES | NO | NO | NO | NO | YES | NO |
| L-Methionine | NO | NO | NO | NO | NO | NO | NO | NO | NO | NO | NO | NO | NO | NO | NO |
| 3-Hydroxy 2-Butanone | NO | NO | NO | NO | NO | NO | NO | NO | NO | NO | NO | NO | NO | NO | NO |

TABLE 36E

Substrate utilization as determined by BIOLOG PM1 MicroPlates by culturable fungi belonging to core OTUs.

| Substrate | SYM 120 | SYM 122 | SYM 123 | SYM 124 | SYM 129 | SYM 300 | SYM 310 | SYM 311 | SYM 314 | SYM 315 | SYM 325 | SYM 326 | SYM 327 | SYM 328 | SYM 1333 | SYM 135 | SYM 136 |
|---|---|---|---|---|---|---|---|---|---|---|---|---|---|---|---|---|---|
| D-Serine | NO | NO | YES | YES | NO | NO | NO | YES | NO | YES | NO | NO | NO | NO | NO | NO | NO |
| D-Glucose-6-Phosphate | NO | NO | NO | YES | YES | NO | NO | NO | YES | NO | NO | NO | YES | YES | NO | NO | NO |
| L-Asparagine | NO | NO | NO | YES | NO | YES | YES | YES | YES | NO | YES | YES | YES | YES | YES | NO | NO |
| L-glutamine | NO | NO | NO | YES | YES | YES | YES | YES | YES | NO | YES | YES | YES | NO | YES | YES | NO |
| Glycyl-L-Aspartic acid | NO | NO | NO | NO | NO | YES | NO | YES | NO | YES | NO | YES | n/a | NO | NO | NO | NO |
| Glycyl-L-Glutamic acid | NO | NO | NO | YES | NO | YES | YES | YES | YES | YES | NO | NO | YES | YES | NO | NO | NO |
| Glycyl-L-Proline | NO | NO | NO | YES | NO | YES | NO | YES | NO | NO | NO | YES | YES | YES | NO | NO | NO |
| L-Arabinose | YES | NO | NO | NO | YES | NO | YES | YES | YES | YES | YES | YES | YES | YES | YES | YES | YES |
| D-Sorbitol | NO | NO | YES | YES | YES | YES | YES | YES | YES | YES | YES | YES | YES | YES | YES | YES | YES |
| D-Galactonic acid-?-lactone | NO | NO | NO | NO | NO | YES | NO | NO | YES | NO | NO | NO | YES | NO | YES | NO | NO |
| D-Aspartic acid | NO | NO | YES | YES | NO | NO | NO | YES | NO | NO | NO | NO | NO | NO | NO | NO | NO |
| m-Tartaric acid | NO | NO | NO | YES | NO | YES | NO | YES | YES | YES | NO | NO | NO | NO | NO | NO | NO |
| Citric acid | NO | NO | NO | YES | NO | YES | YES | YES | YES | YES | NO | YES | n/a | NO | YES | NO | NO |
| Tricarballylic acid | NO | NO | NO | YES | NO | YES | NO | YES | YES | NO | YES | NO | YES | YES | NO | YES | NO |
| p-Hydroxy Phenyl acetic acid | NO | NO | NO | YES | NO | NO | NO | NO | YES | NO | NO | YES | YES | NO | NO | NO | NO |
| N-Acetyl-D-Glucosamine | NO | NO | YES | YES | YES | YES | YES | YES | YES | YES | YES | YES | YES | NO | YES | YES | YES |
| Glycerol | YES | NO | NO | YES | YES | YES | YES | YES | NO | YES | YES | NO | YES | YES | YES | NO | NO |
| D-L-Malic acid | NO | NO | NO | YES | NO | YES | YES | YES | YES | YES | NO | NO | YES | YES | YES | NO | NO |
| D-Glucosaminic acid | NO | NO | NO | YES | NO | YES | NO | NO | YES | NO | YES | YES | NO | NO | NO | NO | NO |
| D-Glucose-1-Phosphate | NO | NO | YES | YES | NO | YES | NO | NO | YES | NO | NO | NO | YES | NO | NO | NO | NO |
| m-Inositol | NO | NO | NO | YES | NO | YES | YES | YES | NO | YES | YES | YES | n/a | NO | YES | NO | NO |
| L-Serine | NO | NO | NO | YES | NO | YES | YES | YES | YES | NO | NO | YES | YES | NO | YES | NO | NO |
| m-Hydroxy Phenyl Acetic acid | NO | NO | NO | YES | NO | YES | NO | NO | YES | NO | NO | NO | YES | NO | NO | NO |
| D-Saccharic acid | NO | NO | NO | YES | NO | YES | YES | YES | YES | YES | YES | YES | YES | NO | YES | NO | NO |
| L-Fucose | NO | NO | NO | YES | NO | YES | NO | YES | YES | YES | NO | NO | YES | NO | NO | NO | NO |
| D-Ribose | NO | NO | YES | YES | YES | YES | YES | YES | NO | YES | YES | YES | YES | YES | NO | YES | NO |
| 1,2-Propanediol | NO | NO | NO | YES | NO | NO | NO | NO | NO | NO | NO | NO | NO | NO | NO | NO | NO |
| D-Fructose-6-Phosphate | NO | NO | NO | NO | NO | NO | NO | NO | NO | NO | NO | NO | NO | NO | NO | NO | NO |
| D-Threonine | NO | NO | YES | YES | NO | NO | NO | YES | NO | NO | NO | NO | n/a | YES | NO | NO | NO |
| L-Threonine | NO | YES | NO | YES | NO | YES | NO | YES | NO | NO | NO | YES | NO | YES | NO | NO | NO |
| Tyramine | YES | NO | NO | YES | NO | YES | YES | YES | YES | YES | NO | YES | YES | NO | YES | NO | NO |
| Succinic acid | NO | NO | NO | YES | NO | NO | YES | YES | YES | NO | NO | YES | YES | NO | YES | NO | NO |
| D-Glucuronic acid | NO | NO | YES | YES | YES | YES | YES | YES | YES | NO | YES | YES | YES | YES | YES | YES | NO |
| Tween 20 | NO | NO | NO | YES | YES | YES | YES | YES | YES | YES | NO | YES | YES | NO | YES | YES | YES |
| Tween 40 | NO | NO | YES | YES | YES | YES | YES | NO | YES | YES | YES | YES | YES | YES | YES | YES | YES |
| Tween 80 | NO | NO | YES | NO | YES | YES | YES | YES | YES | YES | YES | YES | YES | YES | YES | YES | YES |
| Fumaric acid | NO | NO | YES | NO | NO | YES | YES | YES | YES | YES | YES | YES | n/a | YES | YES | NO | NO |
| L-Alanine | NO | NO | NO | YES | NO | YES | YES | YES | YES | YES | YES | YES | YES | YES | YES | NO | NO |
| D-Psicose | NO | NO | NO | YES | NO | NO | NO | NO | NO | NO | NO | NO | NO | YES | NO | NO | NO |
| D-Galactose | YES | NO | YES | YES | NO | YES | YES | YES | YES | YES | YES | YES | YES | YES | YES | YES | YES |
| D-Gluconic acid | NO | NO | NO | YES | YES | YES | YES | YES | YES | NO | YES | YES | YES | YES | YES | YES | YES |
| L-Rhamnose | NO | NO | NO | YES | YES | YES | NO | YES | YES | YES | NO | YES | NO | NO | NO | NO | NO |
| a-Keto-Glutaric acid | NO | NO | NO | YES | NO | YES | YES | YES | YES | NO | NO | YES | YES | YES | YES | NO | NO |
| a-Hydroxy Glutaric acid-?-lactone | NO | NO | YES | YES | NO | YES | YES | YES | YES | NO | NO | NO | YES | YES | YES | NO | NO |
| Bromo succinic acid | NO | NO | YES | YES | NO | YES | YES | YES | YES | NO | YES | YES | n/a | NO | NO | NO | NO |
| L-Alanyl-Glycine | NO | NO | YES | YES | NO | YES | YES | YES | NO | NO | NO | YES | YES | YES | YES | NO | NO |
| L-Lyxose | NO | NO | YES | YES | NO | NO | NO | NO | NO | NO | NO | NO | NO | NO | NO | NO | NO |
| L-Aspartic acid | NO | NO | YES | YES | NO | YES | NO | NO | YES | YES | NO | NO | YES | YES | YES | NO | NO |
| D-L-a-Glycerol phosphate | NO | NO | NO | YES | NO | NO | NO | YES | NO | YES | YES | NO | YES | NO | NO | NO | NO |
| D-Fructose | NO | NO | NO | YES | YES | YES | YES | YES | YES | YES | YES | YES | YES | YES | YES | YES | NO |
| a-Keto-Butyric acid | NO | NO | NO | YES | NO | YES | NO | YES | NO | YES | NO | NO | YES | NO | NO | NO | NO |
| a-Hydroxy Butyric acid | NO | NO | YES | YES | NO | NO | NO | YES | NO | NO | NO | NO | NO | NO | NO | NO | NO |
| Propionic acid | NO | NO | YES | YES | NO | YES | YES | YES | YES | NO | NO | NO | n/a | NO | NO | NO | NO |
| Acetoacetic acid | NO | NO | NO | YES | NO | YES | NO | NO | NO | NO | YES | NO | NO | NO | NO | NO | NO |
| Glucuronamide | NO | NO | NO | NO | NO | NO | NO | NO | NO | NO | NO | NO | NO | NO | NO | NO | NO |
| L-Proline | NO | NO | NO | YES | NO | YES | YES | YES | YES | YES | YES | NO | YES | YES | YES | YES | NO |
| D-Xylose | YES | NO | NO | YES | YES | YES | YES | YES | YES | YES | NO | YES | NO | YES | NO | YES | NO |
| Acetic acid | NO | NO | YES | NO | NO | NO | NO | YES | NO | NO | NO | NO | YES | NO | NO | NO | NO |
| a-Methyl-D-Galactoside | NO | NO | NO | YES | NO | YES | NO | YES | NO | NO | YES | YES | YES | YES | NO | YES | YES |
| β-Methyl-D-glucoside | NO | NO | YES | YES | NO | YES | NO | YES | YES | NO | YES | YES | NO | NO | NO | YES | YES |
| Mucic acid | NO | NO | NO | YES | YES | YES | YES | YES | YES | YES | NO | YES | n/a | YES | YES | NO | NO |

TABLE 36E-continued

Substrate utilization as determined by BIOLOG PM1 MicroPlates by culturable fungi belonging to core OTUs.

| Substrate | | | | | | | | | | | | | | | | | |
|---|---|---|---|---|---|---|---|---|---|---|---|---|---|---|---|---|---|
| N-acetyl-β-D-Mannosamine | NO | NO | YES | YES | NO | NO | NO | NO | NO | YES | NO | NO | NO | YES | NO | NO | NO |
| Pyruvic acid | NO | NO | YES | YES | YES | YES | YES | YES | YES | NO | NO | YES | YES | NO | YES | NO | NO |
| D-Alanine | NO | NO | YES | YES | NO | YES | YES | YES | YES | NO | YES | YES | YES | NO | YES | NO | NO |
| L-Lactic acid | NO | NO | YES | NO | NO | YES | YES | YES | YES | YES | NO | YES | YES | NO | YES | NO | NO |
| a-D-Glucose | NO | NO | NO | YES | YES | YES | YES | YES | YES | YES | YES | YES | YES | YES | YES | YES | YES |
| a-D-Lactose | NO | NO | YES | YES | YES | YES | NO | YES | YES | YES | NO | YES | YES | YES | YES | NO | NO |
| Adonitol | NO | NO | NO | YES | NO | YES | YES | YES | YES | YES | YES | NO | YES | NO | YES | NO | NO |
| Glycolic acid | NO | NO | YES | YES | NO | NO | NO | NO | NO | NO | NO | NO | n/a | NO | NO | NO | NO |
| Mono Methyl Succinate | NO | NO | NO | YES | NO | YES | NO | YES | YES | NO | NO | NO | YES | NO | NO | NO | NO |
| L-Galactonic-acid-?-lactone | NO | NO | NO | NO | NO | YES | YES | YES | YES | NO | YES | YES | YES | NO | YES | YES | NO |
| D-Trehalose | NO | NO | NO | YES | YES | YES | YES | YES | YES | YES | YES | YES | YES | NO | YES | YES | NO |
| Formic acid | NO | NO | NO | YES | NO | NO | NO | NO | NO | YES | NO | NO | NO | YES | NO | NO | NO |
| Maltose | YES | NO | YES | YES | YES | YES | YES | YES | NO | YES | NO | YES | YES | YES | YES | YES | YES |
| Lactulose | YES | NO | NO | YES | NO | YES | NO | YES | NO | YES | NO | NO | YES | YES | NO | NO | NO |
| Maltotriose | NO | NO | YES | YES | YES | YES | NO | YES | YES | YES | YES | YES | YES | YES | NO | YES | YES |
| Glyoxylic acid | NO | NO | YES | YES | NO | NO | NO | NO | NO | NO | NO | NO | n/a | NO | NO | NO | NO |
| Methyl Pyruvate | NO | NO | YES | YES | NO | YES | NO | YES | YES | NO | NO | NO | YES | NO | NO | NO | NO |
| D-Galacturonic acid | NO | NO | YES | YES | YES | YES | YES | YES | YES | NO | NO | YES | YES | NO | YES | NO | NO |
| D-Mannose | NO | NO | YES | YES | YES | YES | YES | YES | YES | NO | YES | YES | YES | YES | YES | YES | YES |
| D-Mannitol | NO | NO | YES | YES | YES | YES | YES | YES | YES | YES | YES | YES | YES | NO | YES | YES | YES |
| D-Melibiose | NO | NO | YES | YES | YES | YES | YES | YES | NO | NO | YES | NO | YES | YES | NO | YES | YES |
| Sucrose | NO | NO | YES | YES | YES | YES | YES | YES | YES | NO | YES | YES | YES | YES | YES | YES | YES |
| 2-Deoxy adenosine | NO | NO | NO | NO | NO | NO | NO | YES | NO | NO | NO | NO | NO | NO | NO | NO | NO |
| D-Cellobiose | NO | NO | YES | YES | NO | YES | YES | YES | YES | NO | YES | YES | n/a | YES | NO | YES | NO |
| D-Malic acid | NO | NO | NO | YES | NO | YES | YES | YES | YES | NO | NO | NO | YES | NO | NO | NO | NO |
| Phenylethyl-amine | NO | NO | NO | NO | NO | NO | NO | NO | NO | NO | NO | NO | NO | NO | NO | NO | NO |
| Dulcitol | NO | NO | YES | YES | YES | YES | NO | YES | NO | NO | NO | NO | YES | NO | YES | NO | NO |
| L-Glutamic acid | NO | NO | YES | YES | NO | YES | YES | YES | YES | YES | YES | YES | YES | NO | YES | YES | YES |
| Thymidine | NO | NO | NO | YES | NO | NO | NO | NO | NO | NO | NO | NO | YES | YES | NO | NO | NO |
| Uridine | NO | NO | YES | YES | NO | YES | YES | YES | YES | NO | NO | YES | YES | NO | YES | NO | YES |
| Adenosine | NO | NO | YES | YES | NO | YES | NO | NO | YES | YES | NO | NO | YES | NO | YES | NO | NO |
| Inosine | NO | NO | NO | YES | YES | YES | YES | YES | YES | NO | YES | n/a | YES | NO | YES | NO | NO |
| L-Malic acid | YES | NO | NO | YES | NO | YES | YES | YES | YES | YES | YES | YES | YES | NO | YES | NO | NO |
| 2-Aminoethanol | NO | NO | YES | YES | NO | YES | YES | YES | YES | NO | YES | NO | YES | NO | YES | NO | NO |

| | Strain | | | | | | | | | | | | | | | |
|---|---|---|---|---|---|---|---|---|---|---|---|---|---|---|---|---|
| Substrate | SYM 151 | SYM 154 | SYM 15811 | SYM 15820 | SYM 15825 | SYM 15828 | SYM 15831 | SYM 15837 | SYM 15839 | SYM 15847 | SYM 15872 | SYM 15890 | SYM 15901 | SYM 15920 | SYM 15926 | SYM 15928 |
| D-Serine | NO | NO | NO | NO | YES | NO | NO | NO | YES | NO | YES | NO | NO | YES | NO | NO |
| D-Glucose-6-Phosphate | YES | YES | NO | NO | NO | NO | NO | NO | NO | NO | NO | NO | NO | NO | NO | NO |
| L-Asparagine | YES | NO | YES | YES | YES | YES | YES | YES | NO | YES | YES | NO | YES | YES | YES | YES |
| L-glutamine | YES | NO | NO | YES | YES | YES | YES | YES | YES | YES | YES | YES | YES | YES | NO | NO |
| Glycyl-L-Aspartic acid | NO | YES | YES | YES | YES | YES | YES | NO | NO | NO | NO | NO | NO | YES | NO | NO |
| Glycyl-L-Glutamic acid | NO | YES | NO | YES | YES | YES | NO | YES | NO | YES | YES | YES | YES | YES | NO | NO |
| Glycyl-L-Proline | YES | YES | NO | YES | YES | YES | YES | NO | YES | NO | YES | NO | YES | YES | NO | YES |
| L-Arabinose | YES | YES | NO | YES | YES | YES | YES | YES | YES | YES | YES | YES | YES | YES | NO | YES |
| D-Sorbitol | YES | YES | YES | YES | YES | YES | YES | YES | YES | YES | YES | YES | YES | YES | NO | YES |
| D-Galactonic acid-?-lactone | NO | YES | YES | YES | NO | NO | NO | YES | YES | NO | NO | NO | NO | YES | YES | NO |
| D-Aspartic acid | NO | YES | NO | NO | NO | NO | YES | NO | NO | NO | NO | NO | NO | YES | NO | YES |
| m-Tartaric acid | YES | NO | NO | NO | YES | NO | NO | YES | NO | YES | NO | YES | NO | YES | NO | NO |
| Citric acid | YES | YES | YES | YES | YES | YES | YES | YES | NO | YES | NO | YES | NO | NO | NO | NO |
| Tricarballylic acid | YES | NO | NO | NO | NO | NO | NO | NO | YES | YES | NO | YES | YES | YES | NO | NO |
| p-Hydroxy Phenyl acetic acid | YES | YES | YES | YES | YES | NO | NO | YES | NO | YES | NO | YES | YES | YES | NO | NO |
| N-Acetyl-D-Glucosamine | YES | YES | NO | YES | YES | YES | YES | NO | YES | YES | YES | YES | YES | YES | YES | YES |
| Glycerol | YES | YES | YES | YES | YES | YES | YES | NO | YES | YES | YES | YES | YES | YES | YES | YES |
| D-L-Malic acid | NO | YES | NO | YES | YES | YES | NO | YES | YES | NO | YES | YES | YES | YES | NO | NO |
| D-Glucosaminic acid | NO | YES | YES | NO | NO | NO | NO | NO | NO | NO | NO | YES | NO | NO | NO | NO |
| D-Glucose-1-Phosphate | NO | NO | NO | NO | NO | NO | NO | NO | NO | NO | NO | NO | NO | NO | NO | NO |
| m-Inositol | YES | YES | NO | YES | YES | YES | YES | YES | YES | YES | YES | YES | YES | YES | NO | NO |
| L-Serine | NO | NO | NO | YES | YES | YES | YES | NO | NO | NO | NO | YES | YES | YES | NO | NO |
| m-HydroxyPhenyl Acetic acid | NO | NO | NO | NO | NO | NO | NO | NO | NO | NO | NO | NO | NO | NO | NO | NO |
| D-Saccharic acid | YES | NO | NO | NO | NO | NO | NO | NO | NO | NO | NO | NO | YES | NO | NO | YES |
| L-Fucose | NO | YES | NO | NO | NO | NO | YES | NO | NO | NO | NO | NO | NO | NO | NO | NO |
| D-Ribose | YES | YES | NO | YES | YES | YES | YES | YES | YES | YES | YES | NO | YES | YES | NO | YES |

TABLE 36E-continued

Substrate utilization as determined by BIOLOG PM1 MicroPlates by culturable fungi belonging to core OTUs.

| Substrate | | | | | | | | | | | | | | | | |
|---|---|---|---|---|---|---|---|---|---|---|---|---|---|---|---|---|
| 1,2-Propanediol | NO | YES | NO | NO | NO | YES | NO | NO | NO | NO | NO | NO | NO | NO | NO | NO |
| D-Fructose-6-Phosphate | NO | YES | NO | NO | NO | NO | NO | NO | NO | NO | NO | NO | NO | NO | NO | NO |
| D-Threonine | NO | NO | NO | NO | NO | NO | NO | YES | NO | NO | NO | NO | YES | NO | NO | NO |
| L-Threonine | NO | NO | YES | YES | YES | NO | NO | YES | NO | NO | YES | NO | YES | YES | NO | NO |
| Tyramine | YES | YES | NO | NO | YES | YES | NO | YES | YES | YES | YES | NO | YES | YES | YES | NO |
| Succinic acid | YES | YES | NO | YES | YES | YES | NO | YES | NO | NO | YES | NO | YES | YES | NO | NO |
| D-Glucuronic acid | NO | YES | NO | YES | YES | YES | NO | NO | NO | YES | YES | YES | YES | YES | YES | YES |
| Tween 20 | YES | YES | YES | YES | YES | YES | YES | YES | YES | YES | YES | NO | YES | YES | YES | YES |
| Tween 40 | YES | YES | YES | YES | YES | YES | YES | YES | YES | NO | YES | YES | YES | YES | NO | YES |
| Tween 80 | YES | YES | NO | YES | YES | YES | YES | YES | YES | YES | YES | YES | YES | YES | NO | YES |
| Fumaric acid | NO | NO | YES | YES | YES | YES | YES | NO | NO | NO | YES | NO | YES | YES | NO | YES |
| L-Alanine | YES | NO | YES | YES | YES | YES | YES | NO | NO | YES | YES | YES | YES | YES | YES | NO |
| D-Psicose | NO | YES | NO | NO | NO | NO | NO | NO | NO | NO | NO | NO | NO | NO | NO | NO |
| D-Galactose | YES | YES | NO | YES | YES | YES | YES | YES | YES | YES | YES | NO | YES | YES | YES | NO |
| D-Gluconic acid | YES | YES | YES | YES | YES | YES | YES | YES | YES | YES | YES | YES | YES | YES | NO | YES |
| L-Rhamnose | YES | YES | NO | NO | YES | NO | NO | YES | YES | YES | YES | NO | YES | YES | NO | NO |
| a-Keto-Glutaric acid | NO | NO | YES | YES | NO | YES | NO | NO | NO | NO | YES | YES | NO | NO | NO | NO |
| a-Hydroxy Glutaric acid-?-lactone | NO | YES | NO | YES | NO | YES | NO | YES | NO | NO | NO | NO | NO | NO | NO | NO |
| Bromo succinic acid | NO | YES | NO | NO | YES | YES | NO | NO | YES | YES | YES | NO | YES | YES | NO | NO |
| L-Alanyl-Glycine | YES | YES | YES | YES | YES | YES | YES | YES | YES | YES | YES | YES | YES | YES | NO | YES |
| L-Lyxose | NO | NO | NO | NO | NO | NO | NO | NO | NO | NO | NO | NO | NO | YES | YES | NO |
| L-Aspartic acid | YES | NO | NO | YES | YES | YES | YES | YES | NO | YES | YES | YES | YES | YES | NO | YES |
| D-L-a-Glycerol phosphate | NO | YES | YES | YES | NO | YES | NO | YES | YES | NO | YES | NO | NO | NO | YES | NO |
| D-Fructose | YES | YES | YES | YES | YES | YES | YES | YES | YES | YES | YES | YES | YES | YES | NO | NO |
| a-Keto-Butyric acid | NO | YES | NO | NO | YES | NO | NO | NO | NO | YES | YES | NO | NO | NO | NO | NO |
| a-Hydroxy Butyric acid | NO | YES | NO | NO | YES | NO | NO | NO | NO | NO | NO | NO | NO | NO | NO | NO |
| Propionic acid | NO | YES | NO | NO | YES | YES | YES | YES | YES | NO | NO | YES | YES | YES | NO | NO |
| Acetoacetic acid | NO | NO | NO | NO | NO | NO | NO | NO | NO | NO | NO | NO | YES | NO | NO | NO |
| Glucuronamide | NO | NO | YES | NO | NO | NO | YES | NO | NO | NO | NO | NO | NO | NO | NO | NO |
| L-Proline | YES | YES | NO | YES | YES | YES | YES | YES | YES | YES | YES | YES | YES | YES | YES | YES |
| D-Xylose | YES | NO | YES | YES | YES | YES | YES | YES | YES | YES | YES | NO | YES | YES | NO | YES |
| Acetic acid | YES | YES | NO | YES | YES | YES | YES | YES | YES | YES | YES | NO | YES | YES | YES | NO |
| a-Methyl-D-Galactoside | YES | NO | NO | NO | YES | YES | YES | YES | YES | YES | YES | NO | YES | YES | NO | NO |
| β-Methyl-D-glucoside | YES | YES | NO | NO | YES | YES | YES | YES | YES | YES | YES | NO | YES | YES | NO | YES |
| Mucic acid | YES | YES | NO | YES | YES | YES | YES | YES | YES | YES | YES | YES | YES | YES | NO | NO |
| N-acetyl-β-D-Mannosamine | NO | YES | NO | NO | NO | YES | NO | YES | NO | NO | NO | NO | NO | NO | NO | NO |
| Pyruvic acid | YES | YES | NO | YES | YES | YES | YES | NO | YES | YES | YES | YES | YES | YES | NO | YES |
| D-Alanine | YES | NO | YES | YES | NO | YES | YES | YES | NO | NO | NO | NO | NO | YES | YES | NO |
| L-Lactic acid | YES | NO | NO | YES | YES | YES | YES | NO | YES | YES | YES | NO | YES | YES | NO | YES |
| a-D-Glucose | YES | YES | YES | YES | YES | YES | YES | YES | YES | YES | YES | YES | YES | YES | YES | YES |
| a-D-Lactose | YES | NO | NO | NO | YES | NO | NO | YES | NO | YES | NO | NO | YES | YES | NO | NO |
| Adonitol | YES | YES | YES | YES | YES | YES | NO | YES | NO | NO | YES | NO | YES | YES | NO | NO |
| Glycolic acid | NO | YES | NO | NO | YES | NO | NO | NO | NO | NO | NO | NO | NO | NO | NO | NO |
| Mono Methyl Succinate | YES | NO | NO | NO | YES | NO | YES | NO | NO | NO | NO | YES | NO | NO | NO | YES |
| L-Galactonic-acid-?-lactone | YES | YES | NO | YES | YES | YES | YES | YES | YES | YES | YES | YES | YES | YES | YES | YES |
| D-Trehalose | YES | YES | NO | YES | YES | YES | YES | YES | YES | YES | YES | YES | YES | YES | NO | YES |
| Formic acid | YES | NO | NO | NO | YES | NO | NO | NO | NO | NO | YES | YES | YES | NO | NO | NO |
| Maltose | YES | YES | NO | YES | YES | NO | YES | YES | YES | YES | YES | YES | YES | YES | YES | YES |
| Lactulose | YES | YES | NO | NO | YES | NO | NO | YES | NO | YES | NO | YES | YES | YES | NO | NO |
| Maltotriose | YES | NO | NO | YES | YES | YES | YES | YES | YES | YES | YES | NO | YES | YES | YES | YES |
| Glyoxylic acid | NO | YES | NO | NO | YES | NO | NO | NO | NO | NO | YES | NO | YES | NO | NO | NO |
| Methyl Pyruvate | YES | NO | NO | YES | YES | NO | NO | NO | NO | YES | YES | YES | YES | YES | NO | YES |
| D-Galacturonic acid | YES | YES | YES | YES | YES | YES | YES | YES | YES | YES | YES | YES | NO | YES | YES | NO |
| D-Mannose | YES | YES | NO | YES | YES | YES | YES | YES | YES | YES | YES | YES | YES | YES | NO | YES |
| D-Mannitol | YES | YES | YES | YES | YES | YES | YES | YES | YES | YES | YES | NO | YES | YES | NO | YES |
| D-Melibiose | YES | NO | NO | YES | YES | YES | YES | YES | YES | YES | YES | NO | YES | YES | NO | YES |
| Sucrose | YES | YES | NO | YES | YES | YES | YES | YES | YES | YES | YES | NO | YES | YES | NO | YES |
| 2-Deoxy adenosine | YES | NO | NO | NO | YES | NO | NO | NO | NO | YES | NO | NO | YES | NO | NO | NO |
| D-Cellobiose | YES | YES | NO | YES | NO | YES | YES | YES | YES | YES | YES | YES | YES | YES | NO | YES |
| D-Malic acid | YES | YES | YES | NO | YES | NO | YES | YES | NO | YES | NO | YES | YES | NO | NO | NO |
| Phenylethyl-amine | NO | NO | NO | NO | NO | NO | NO | NO | NO | NO | NO | NO | NO | NO | NO | NO |
| Dulcitol | YES | YES | NO | NO | YES | NO | NO | YES | NO | YES | YES | NO | YES | NO | NO | YES |
| L-Glutamic acid | YES | YES | NO | YES | YES | YES | YES | YES | NO | YES | YES | YES | YES | YES | NO | NO |
| Thymidine | NO | YES | NO | NO | YES | NO | NO | NO | NO | NO | YES | NO | YES | NO | NO | NO |
| Uridine | YES | YES | YES | YES | YES | YES | YES | YES | NO | YES | YES | YES | YES | NO | NO | NO |
| Adenosine | NO | YES | NO | YES | NO | YES | NO | NO | NO | YES | YES | YES | YES | NO | NO | NO |
| Inosine | YES | NO | YES | YES | NO | YES | YES | YES | NO | NO | NO | YES | YES | YES | YES | NO |

TABLE 36E-continued

Substrate utilization as determined by BIOLOG PM1 MicroPlates by culturable fungi belonging to core OTUs.

| | | | | | | | | | | | | | | | | | |
|---|---|---|---|---|---|---|---|---|---|---|---|---|---|---|---|---|---|
| L-Malic acid | YES | YES | NO | YES | NO | YES | YES | NO | NO | YES | YES | NO | YES | YES | NO | YES | |
| 2-Aminoethanol | YES | YES | NO | YES | YES | YES | NO | YES | NO | YES | YES | NO | YES | YES | YES | YES | |

| | Strain | | | | | | | | | | | | | | | | |
|---|---|---|---|---|---|---|---|---|---|---|---|---|---|---|---|---|---|
| Substrate | SYM 15932 | SYM 160 | SYM 34 | SYM 566B | SYM 577 | SYM 590 | SYM 603 | SYM 61A | SYM 622 | SYM 629 | SYM 66 | SYM 663 | SYM 696 | SYM 741A | SYM 741B | SYM 854 | SYM 880 |
| D-Serine | NO | NO | NO | NO | NO | NO | NO | YES | NO | NO | NO | NO | NO | NO | NO | NO | NO |
| D-Glucose-6-Phosphate | NO | NO | NO | NO | NO | NO | NO | NO | NO | NO | NO | NO | NO | NO | NO | NO | NO |
| L-Asparagine | NO | NO | YES | NO | YES | YES | YES | YES | YES | YES | NO | YES | YES | YES | YES | YES | YES |
| L-glutamine | NO | YES | YES | YES | YES | NO | YES | YES | YES | YES | NO | YES | YES | YES | YES | YES | NO |
| Glycyl-L-Aspartic acid | NO | NO | YES | NO | NO | NO | NO | YES | NO | NO | NO | NO | NO | NO | NO | NO | NO |
| Glycyl-L-Glutamic acid | NO | NO | NO | NO | NO | NO | YES | YES | NO | NO | YES | NO | NO | NO | YES | NO | NO |
| Glycyl-L-Proline | NO | YES | NO | YES | YES | NO | YES | YES | NO | NO | NO | NO | NO | NO | YES | NO | NO |
| L-Arabinose | YES | NO | YES | NO | YES | YES | YES | YES | YES | NO | NO | YES | NO | YES | YES | NO | NO |
| D-Sorbitol | NO | NO | YES | NO | YES | YES | YES | NO | YES | YES | NO | NO | NO | YES | YES | NO | NO |
| D-Galactonic acid-?-lactone | NO | NO | NO | YES | NO | YES | NO | NO | NO | NO | NO | NO | NO | NO | YES | NO | NO |
| D-Aspartic acid | NO | NO | NO | NO | NO | NO | NO | NO | NO | NO | YES | NO | NO | NO | YES | NO | NO |
| m-Tartaric acid | NO | NO | NO | YES | YES | NO | NO | YES | NO | NO | NO | NO | NO | NO | NO | NO | NO |
| Citric acid | NO | NO | NO | YES | YES | NO | YES | YES | YES | YES | NO | YES | NO | YES | YES | YES | NO |
| Tricarballylic acid | NO | NO | NO | NO | NO | NO | NO | NO | NO | NO | NO | NO | NO | NO | NO | NO | NO |
| p-Hydroxy Phenyl acetic acid | NO | NO | NO | YES | YES | NO | YES | NO | NO | NO | YES | NO | NO | YES | NO | NO | NO |
| N-Acetyl-D-Glucosamine | NO | NO | YES | YES | YES | YES | YES | YES | YES | YES | NO | YES | NO | YES | YES | NO | NO |
| Glycerol | NO | NO | YES | YES | NO | NO | YES | YES | NO | YES | YES | YES | YES | YES | YES | NO | NO |
| D-L-Malic acid | NO | YES | NO | NO | YES | NO | YES | YES | YES | YES | NO | YES | NO | NO | YES | YES | YES |
| D-Glucosaminic acid | NO | NO | YES | YES | NO | NO | YES | NO | NO | NO | YES | NO | NO | NO | YES | NO | NO |
| D-Glucose-1-Phosphate | NO | NO | NO | NO | NO | NO | NO | NO | NO | NO | YES | NO | NO | NO | NO | NO | NO |
| m-Inositol | NO | NO | NO | YES | YES | NO | YES | YES | YES | YES | NO | NO | NO | NO | YES | NO | NO |
| L-Serine | NO | NO | NO | YES | YES | NO | YES | YES | YES | NO | NO | YES | NO | YES | YES | YES | NO |
| m-HydroxyPhenyl Acetic acid | NO | NO | NO | NO | NO | NO | NO | NO | NO | NO | YES | NO | NO | NO | NO | NO | NO |
| D-Saccharic acid | NO | NO | NO | YES | YES | NO | YES | YES | YES | NO | NO | YES | NO | YES | YES | YES | NO |
| L-Fucose | NO | NO | NO | NO | NO | NO | NO | NO | NO | NO | NO | NO | NO | NO | NO | NO | NO |
| D-Ribose | NO | NO | YES | YES | YES | YES | YES | YES | YES | YES | NO | NO | NO | NO | YES | NO | NO |
| 1,2-Propanediol | NO | NO | NO | NO | NO | NO | NO | NO | NO | NO | YES | NO | NO | NO | NO | NO | NO |
| D-Fructose-6-Phosphate | NO | NO | NO | YES | NO | NO | NO | NO | NO | NO | NO | NO | NO | NO | NO | NO | NO |
| D-Threonine | NO | NO | NO | NO | NO | NO | NO | YES | NO | NO | NO | NO | NO | NO | NO | NO | NO |
| L-Threonine | NO | NO | NO | NO | YES | NO | NO | YES | NO | NO | NO | NO | NO | NO | NO | NO | NO |
| Tyramine | YES | NO | NO | NO | YES | NO | YES | NO | YES | YES | NO | NO | NO | NO | NO | NO | NO |
| Succinic acid | NO | NO | YES | NO | NO | NO | YES | YES | YES | YES | YES | NO | NO | NO | YES | YES | NO |
| D-Glucuronic acid | YES | NO | NO | NO | YES | NO | YES | YES | YES | YES | NO | YES | NO | YES | YES | NO | NO |
| Tween 20 | NO | NO | YES | NO | YES | YES | YES | NO | YES | NO | NO | NO | NO | NO | YES | YES | NO |
| Tween 40 | NO | YES | YES | YES | YES | NO | YES | YES | YES | YES | NO | YES | NO | NO | YES | YES | NO |
| Tween 80 | NO | NO | YES | YES | YES | NO | YES | YES | YES | YES | YES | YES | YES | NO | YES | YES | NO |
| Fumaric acid | NO | YES | YES | YES | NO | YES | YES | YES | YES | YES | NO | NO | NO | YES | YES | YES | NO |
| L-Alanine | NO | NO | NO | NO | YES | YES | YES | YES | YES | NO | YES | YES | YES | YES | YES | YES | NO |
| D-Psicose | NO | NO | NO | NO | NO | NO | YES | NO | NO | YES | NO | NO | NO | NO | NO | NO | NO |
| D-Galactose | NO | NO | YES | NO | YES | NO | YES | YES | YES | YES | NO | NO | YES | NO | YES | YES | NO |
| D-Gluconic acid | NO | NO | NO | YES | YES | YES | YES | YES | YES | YES | NO | NO | NO | YES | YES | YES | NO |
| L-Rhamnose | NO | NO | YES | NO | YES | NO | YES | NO | YES | NO | NO | NO | NO | NO | NO | YES | NO |
| a-Keto-Glutaric acid | NO | NO | YES | NO | NO | NO | YES | NO | YES | NO | YES | NO | YES | YES | YES | YES | NO |
| a-Hydroxy Glutaric acid-?-lactone | NO | NO | NO | YES | YES | NO | YES | YES | YES | NO | NO | NO | NO | YES | YES | NO | NO |
| Bromo succinic acid | NO | NO | YES | NO | NO | NO | YES | YES | NO | NO | NO | NO | NO | NO | YES | YES | NO |
| L-Alanyl-Glycine | NO | NO | NO | NO | NO | NO | YES | YES | YES | YES | NO | YES | NO | NO | YES | YES | NO |
| L-Lyxose | NO | YES | NO | NO | NO | NO | NO | YES | NO | NO | NO | NO | NO | NO | NO | YES | NO |
| L-Aspartic acid | NO | NO | YES | YES | YES | NO | YES | YES | YES | YES | NO | YES | NO | YES | YES | YES | NO |
| D-L-a-Glycerol phosphate | NO | NO | NO | YES | NO | YES | NO | YES | YES | NO | YES | NO | YES | NO | NO | NO | NO |
| D-Fructose | YES | YES | YES | YES | YES | YES | YES | YES | YES | YES | NO | YES | YES | NO | YES | YES | NO |
| a-Keto-Butyric acid | NO | NO | NO | NO | NO | NO | YES | NO | YES | NO | NO | NO | NO | NO | NO | NO | NO |
| a-HydroxyButyric acid | NO | NO | NO | NO | NO | NO | NO | NO | NO | NO | YES | NO | NO | NO | NO | NO | NO |
| Propionic acid | NO | NO | NO | NO | NO | NO | YES | NO | NO | NO | NO | YES | NO | NO | YES | NO | NO |
| Acetoacetic acid | NO | NO | NO | NO | NO | NO | NO | NO | YES | NO | NO | NO | NO | YES | NO | NO | NO |
| Glucuronamide | NO | NO | NO | NO | NO | NO | NO | NO | NO | NO | NO | NO | NO | NO | NO | NO | NO |
| L-Proline | NO | NO | YES | NO | YES | NO | YES | YES | YES | YES | NO | YES | YES | YES | YES | YES | NO |
| D-Xylose | NO | NO | NO | NO | YES | YES | YES | YES | YES | YES | NO | YES | NO | YES | NO | YES | NO |
| Acetic acid | NO | NO | NO | NO | NO | NO | NO | NO | NO | NO | NO | NO | NO | NO | YES | NO | NO |

TABLE 36E-continued

Substrate utilization as determined by BIOLOG PM1 MicroPlates by culturable fungi belonging to core OTUs.

| Substrate | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| a-Methyl-D-Galactoside | YES | NO | NO | NO | YES | NO | NO | YES | NO | NO | NO | NO | NO | NO | NO | NO | NO |
| β-Methyl-D-glucoside | YES | YES | YES | YES | YES | YES | NO | YES | NO | NO | YES | NO | YES | NO | NO | YES | YES |
| Mucic acid | NO | NO | NO | YES | YES | NO | YES | YES | YES | YES | NO | YES | NO | YES | YES | YES | NO |
| N-acetyl-β-D-Mannosamine | NO | NO | NO | NO | NO | NO | NO | YES | NO | NO | NO | NO | NO | NO | NO | NO | NO |
| Pyruvic acid | NO | NO | NO | NO | YES | NO | NO | YES | NO | NO | YES | NO | NO | YES | NO | NO | NO |
| D-Alanine | NO | NO | NO | YES | YES | NO | YES | YES | YES | YES | NO | NO | NO | NO | YES | YES | NO |
| L-Lactic acid | NO | NO | NO | NO | NO | NO | YES | YES | YES | NO | NO | YES | YES | NO | YES | NO | NO |
| a-D-Glucose | YES | YES | YES | YES | YES | YES | YES | YES | YES | YES | YES | YES | YES | YES | YES | YES | NO |
| a-D-Lactose | NO | NO | NO | NO | NO | NO | NO | YES | NO | NO | NO | NO | YES | NO | NO | YES | NO |
| Adonitol | NO | NO | NO | NO | YES | NO | YES | YES | YES | YES | NO | YES | NO | NO | YES | YES | NO |
| Glycolic acid | NO | NO | NO | NO | NO | NO | NO | NO | NO | NO | NO | NO | NO | NO | NO | NO | NO |
| Mono Methyl Succinate | YES | NO | NO | NO | YES | NO | NO | YES | NO | NO | NO | YES | NO | NO | YES | NO | NO |
| L-Galactonic-acid-?-lactone | NO | NO | NO | NO | YES | NO | YES | YES | NO | YES | NO | NO | YES | NO | YES | YES | NO |
| D-Trehalose | YES | NO | YES | YES | YES | YES | YES | YES | YES | YES | NO | NO | YES | YES | YES | YES | NO |
| Formic acid | NO | NO | NO | NO | NO | NO | NO | NO | NO | NO | NO | NO | NO | NO | NO | NO | NO |
| Maltose | YES | YES | YES | NO | YES | YES | NO | NO | NO | NO | YES | YES | YES | YES | NO | YES | YES |
| Lactulose | NO | NO | NO | NO | NO | NO | NO | YES | NO | NO | NO | YES | YES | NO | NO | YES | NO |
| Maltotriose | YES | YES | YES | NO | YES | YES | NO | YES | NO | NO | YES | YES | YES | NO | NO | YES | YES |
| Glyoxylic acid | NO | NO | NO | NO | NO | NO | NO | NO | NO | NO | NO | NO | NO | NO | NO | NO | NO |
| Methyl Pyruvate | NO | YES | NO | NO | NO | NO | YES | NO | YES | NO | YES | NO | NO | YES | NO | NO | NO |
| D-Galacturonic acid | NO | NO | NO | NO | YES | YES | YES | YES | YES | YES | YES | NO | YES | NO | YES | YES | NO |
| D-Mannose | YES | YES | YES | YES | YES | NO | YES | YES | YES | NO | NO | YES | YES | NO | YES | YES | NO |
| D-Mannitol | YES | NO | YES | YES | YES | YES | YES | YES | NO | YES | YES | NO | NO | NO | YES | YES | NO |
| D-Melibiose | NO | NO | NO | NO | YES | NO | YES | NO | YES | NO | YES | NO | YES | NO | YES | YES | NO |
| Sucrose | YES | YES | YES | YES | YES | NO | YES | YES | YES | NO | YES | YES | YES | YES | YES | YES | YES |
| 2-Deoxy adenosine | NO | NO | NO | NO | YES | NO | NO | YES | NO | NO | NO | NO | NO | NO | NO | NO | NO |
| D-Cellobiose | YES | YES | YES | NO | YES | YES | NO | YES | YES | NO | YES | YES | YES | YES | NO | YES | YES |
| D-Malic acid | NO | NO | NO | NO | YES | NO | YES | YES | NO | YES | NO | NO | NO | NO | NO | YES | NO |
| Phenylethyl-amine | NO | NO | NO | NO | NO | NO | NO | NO | NO | NO | NO | NO | NO | NO | NO | NO | NO |
| Dulcitol | NO | NO | YES | YES | YES | YES | NO | YES | NO | NO | YES | NO | YES | NO | NO | YES | NO |
| L-Glutamic acid | NO | NO | YES | NO | NO | NO | YES | YES | YES | YES | NO | YES | YES | NO | YES | YES | NO |
| Thymidine | NO | NO | NO | NO | NO | NO | NO | NO | NO | NO | NO | NO | NO | NO | NO | NO | NO |
| Uridine | NO | NO | NO | NO | YES | NO | YES | YES | YES | YES | NO | NO | NO | NO | YES | YES | NO |
| Adenosine | NO | YES | NO | NO | NO | NO | YES | NO | YES | NO | NO | NO | NO | YES | NO | NO | NO |
| Inosine | NO | NO | NO | YES | YES | NO | YES | YES | YES | YES | NO | YES | YES | NO | YES | NO | NO |
| L-Malic acid | NO | NO | YES | NO | YES | YES | YES | YES | YES | NO | NO | YES | YES | YES | YES | YES | NO |
| 2-Aminoethanol | NO | NO | NO | NO | YES | NO | YES | YES | YES | YES | NO | NO | NO | NO | YES | NO | NO |

TABLE 36F

Substrate utilization as determined by BIOLOG PM2A MicroPlates by culturable fungi belonging to core OTUs.

| Strain/Substrate | SYM-120 | SYM-122 | SYM-123 | SYM-124 | SYM-129 | SYM-1300 | SYM-1310 | SYM-1311 | SYM-1314 | SYM-1315 | SYM-1324 | SYM-1325 | SYM-1326 | SYM-1327 | SYM-1333 |
|---|---|---|---|---|---|---|---|---|---|---|---|---|---|---|---|
| N-acetyl-D-Galactosamine | NO | NO | YES | NO | NO | YES | NO | NO | YES | YES | NO | NO | NO | YES | NO |
| Gentiobiose | NO | NO | YES | YES | YES | NO | NO | YES | NO | YES | YES | YES | NO | NO | |
| D-Raffinose | NO | NO | YES | YES | YES | NO | NO | YES | NO | NO | NO | YES | YES | NO | NO |
| Carpice acid | NO | NO | NO | NO | NO | YES | NO | NO | NO | NO | NO | NO | YES | YES | YES |
| D-lactic acid methyl ester | NO | YES | YES | NO | NO | NO | NO | NO | NO | NO | NO | NO | NO | NO | NO |
| Acetamide | NO | NO | YES | NO | NO | NO | NO | NO | NO | NO | NO | NO | NO | NO | NO |
| L-Ornithine | NO | YES | YES | YES | YES | YES | YES | YES | YES | YES | NO | YES | YES | YES | YES |
| Chondrointin sulfate C | NO | NO | YES | NO | NO | NO | NO | NO | YES | NO | NO | NO | NO | NO | NO |
| N-acetyl-neuraminic acid | NO | YES | YES | NO | NO | YES | NO | NO | YES | NO | NO | NO | YES | NO | NO |
| L-glucose | NO | YES | NO | NO | NO | NO | NO | NO | NO | NO | NO | NO | NO | NO | NO |
| Salicin | YES | NO | NO | YES | NO | NO | NO | YES | NO | NO | YES | YES | NO | NO | NO |

TABLE 36F-continued

Substrate utilization as determined by BIOLOG PM2A MicroPlates by culturable fungi belonging to core OTUs.

| | | | | | | | | | | | | | | |
|---|---|---|---|---|---|---|---|---|---|---|---|---|---|---|
| Caproic acid | NO | NO | NO | NO | NO | YES | NO | NO | NO | NO | NO | NO | YES | NO | NO |
| Malonic acid | NO | NO | YES | YES | NO | YES | NO | NO | NO | NO | NO | NO | NO | NO | NO |
| L-Alaninamide | NO | NO | YES | NO | NO | YES | NO | NO | YES | NO | NO | YES | YES | YES | YES |
| L-Phenylalanine | YES | NO | NO | NO | NO | YES | NO | YES | YES | NO | NO | NO | NO | YES | NO |
| α-Cyclodextrin | YES | YES | YES | YES | YES | YES | YES | YES | YES | YES | YES | YES | YES | YES | YES |
| β-D-allose | NO | NO | YES | NO | NO | NO | NO | NO | NO | YES | NO | NO | NO | NO | NO |
| Lactitol | NO | NO | NO | NO | NO | NO | NO | NO | NO | YES | YES | NO | NO | NO | NO |
| Sedoheptulosan | YES | YES | NO | YES | NO | NO | NO | NO | NO | NO | NO | NO | NO | NO | NO |
| Citraconic acid | NO | YES | YES | NO | NO | NO | NO | NO | YES | NO | NO | NO | NO | NO | NO |
| Melibionic acid | NO | NO | NO | NO | NO | NO | NO | NO | YES | YES | NO | NO | NO | NO | NO |
| N-Acetyl-L-Glutamic acid | NO | NO | NO | NO | NO | YES | YES | NO | YES | NO | NO | NO | YES | YES | YES |
| L-Pyroglutamic acid | NO | NO | YES | NO | NO | YES | YES | YES | YES | YES | NO | YES | YES | YES | YES |
| β-Cyclodextrin | NO | YES | YES | NO | NO | NO | NO | NO | NO | NO | NO | NO | NO | NO | NO |
| Amygdalin | NO | NO | NO | YES | NO | NO | NO | YES | NO | NO | NO | YES | NO | NO | NO |
| D-Melezitose | NO | YES | YES | NO | YES | NO | NO | YES | NO | NO | YES | YES | NO | NO | NO |
| L-Sorbose | NO | NO | YES | NO | YES | NO | NO | NO | NO | NO | NO | NO | NO | NO | NO |
| Citramalic acid | YES | NO | NO | NO | NO | NO | NO | NO | NO | NO | NO | NO | NO | YES | NO |
| Oxalic acid | NO | NO | YES | YES | NO | NO | NO | NO | NO | NO | NO | NO | NO | NO | NO |
| L-Arginine | NO | NO | NO | YES | NO | YES | YES | YES | YES | YES | NO | YES | YES | YES | YES |
| L-Valine | NO | YES | YES | NO | NO | YES | YES | YES | YES | NO | NO | YES | YES | YES | YES |
| γ-Cyclodextrin | NO | NO | YES | YES | NO | NO | NO | NO | YES | NO | YES | NO | NO | NO | YES |
| D-arabinose | NO | NO | NO | YES | NO | NO | NO | NO | YES | NO | NO | NO | NO | NO | NO |
| Maltitol | NO | NO | YES | YES | YES | NO | NO | YES | NO | NO | YES | NO | NO | NO | NO |
| Stachyose | NO | NO | NO | YES | NO | NO | NO | YES | NO | NO | YES | YES | NO | NO | NO |
| D-Glucosamine | NO | NO | NO | NO | NO | YES | NO | NO | YES | NO | NO | NO | NO | YES | NO |
| Oxalomalic acid | NO | NO | YES | YES | NO | NO | NO | NO | YES | NO | NO | NO | NO | NO | NO |
| Glycine | NO | NO | NO | YES | NO | NO | NO | NO | NO | NO | NO | NO | NO | NO | YES |
| D,L-Carnitine | NO | YES | NO | NO | NO | YES | NO | NO | YES | NO | NO | NO | YES | YES | NO |
| Dextrin | NO | NO | YES | NO | YES | NO | NO | YES | NO | YES | NO | YES | NO | NO | NO |
| D-arabitol | NO | YES | NO | YES | NO | NO | NO | YES | NO | YES | YES | YES | NO | NO | YES |
| α-Methyl-D-Glucoside | NO | NO | NO | NO | NO | NO | NO | NO | NO | NO | YES | NO | NO | NO | NO |
| D-Tagatose | NO | NO | NO | YES | NO | NO | NO | NO | NO | NO | NO | NO | NO | NO | NO |
| 2-Hydroxy benzoic acid | NO | YES | NO | NO | NO | NO | NO | NO | YES | YES | NO | NO | YES | NO | NO |
| Quinic acid | NO | NO | NO | NO | NO | YES | NO | YES | YES | NO | YES | YES | NO | NO | NO |
| L-Histidine | NO | NO | NO | NO | YES | YES | YES | YES | YES | YES | YES | NO | YES | YES | YES |
| Sec-Butylamine | NO | NO | NO | NO | NO | NO | NO | NO | NO | NO | NO | NO | NO | NO | NO |
| Gelatin | YES | YES | YES | YES | NO | YES | YES | YES | YES | YES | YES | YES | YES | YES | YES |
| L-arabitol | NO | YES | YES | NO | NO | NO | NO | NO | YES | NO | NO | NO | NO | NO | NO |
| β-Methyl-D-Galactoside | NO | NO | YES | NO | NO | NO | NO | YES | NO | NO | NO | NO | NO | NO | NO |
| Turanose | NO | YES | YES | YES | YES | NO | YES | YES | NO | NO | NO | NO | NO | NO | NO |
| 4-Hydroxy benzoic acid | NO | YES | NO | NO | NO | NO | NO | NO | YES | NO | NO | NO | NO | NO | NO |
| D-Ribono-1,4-Lactone | NO | YES | YES | NO | NO | NO | NO | NO | NO | YES | NO | NO | YES | NO | NO |
| L-Homoserine | NO | NO | NO | NO | NO | NO | NO | NO | NO | NO | NO | NO | NO | NO | NO |

TABLE 36F-continued

Substrate utilization as determined by BIOLOG PM2A MicroPlates by culturable fungi belonging to core OTUs.

| Substrate | SYM-135 | SYM-136 | SYM-151 | SYM-154 | SYM-15811 | SYM-15820 | SYM-15825 | SYM-15828 | SYM-15831 | SYM-15837 | SYM-15839 | SYM-15847 | SYM-15872 | SYM-15890 | SYM-15901 | SYM-15920 | SYM-15926 |
|---|---|---|---|---|---|---|---|---|---|---|---|---|---|---|---|---|---|
| D,L-Octopamine | NO | NO | YES | NO | NO | YES | YES | YES | YES | NO | NO | NO | YES | YES | YES | | |
| Glycogen | YES | YES | YES | YES | NO | YES | NO | YES | NO | YES | YES | YES | YES | NO | NO | | |
| Arbutin | NO | NO | YES | YES | NO | NO | NO | YES | NO | YES | YES | YES | NO | NO | NO | | |
| 3-Methyl Glucose | YES | NO | NO | NO | NO | NO | NO | NO | NO | NO | NO | NO | NO | NO | NO | | |
| Xylitol | NO | NO | YES | NO | NO | NO | NO | NO | NO | YES | NO | NO | NO | NO | NO | | |
| β-Hydroxy butyric acid | NO | NO | YES | NO | NO | YES | NO | YES | NO | YES | YES | YES | NO | YES | YES | | |
| Sebacic acid | YES | YES | YES | NO | NO | YES | NO | NO | NO | YES | NO | NO | NO | NO | NO | | |
| Hydroxy-L-Proline | NO | NO | NO | YES | NO | YES | YES | YES | YES | YES | NO | YES | YES | YES | YES | | |
| Putrescine | NO | YES | NO | YES | YES | YES | YES | YES | NO | YES | NO | YES | NO | NO | NO | | |
| Inulin | NO | YES | YES | NO | NO | NO | NO | NO | NO | YES | NO | NO | YES | NO | NO | | |
| 2-Deoxy-D-Ribose | NO | NO | NO | NO | NO | NO | NO | NO | NO | NO | NO | NO | NO | NO | NO | | |
| β-Methyl-D-Glucuronic acid | YES | YES | NO | NO | NO | NO | NO | NO | NO | YES | NO | NO | NO | NO | NO | | |
| N-Acetyl-D-glucosaminitol | NO | YES | YES | NO | NO | NO | NO | NO | NO | NO | NO | NO | NO | NO | NO | | |
| γ-Hydroxy butyric acid | NO | YES | YES | NO | NO | NO | NO | NO | NO | YES | NO | NO | NO | NO | NO | | |
| Sorbic acid | NO | NO | YES | NO | NO | NO | NO | NO | NO | NO | NO | NO | NO | NO | NO | | |
| L-Isoleucine | NO | NO | NO | YES | YES | YES | YES | YES | YES | NO | NO | YES | YES | YES | YES | | |
| Dihydroxy acetone | NO | NO | YES | NO | NO | NO | NO | NO | NO | NO | NO | NO | NO | NO | NO | | |
| Laminarin | NO | NO | NO | NO | NO | NO | NO | NO | NO | YES | NO | NO | NO | NO | NO | | |
| i-Erythritol | NO | NO | YES | NO | NO | NO | YES | NO | NO | YES | NO | NO | NO | NO | YES | | |
| a-Methyl-D-Mannoside | NO | NO | YES | NO | NO | NO | NO | NO | NO | YES | NO | NO | NO | NO | NO | | |
| γ-amino butyric acid | NO | YES | NO | NO | YES | YES | YES | YES | YES | YES | YES | YES | YES | YES | YES | | |
| a-Keto-valeric acid | NO | NO | YES | NO | NO | NO | NO | NO | NO | YES | NO | NO | NO | NO | NO | | |
| Succinamic acid | NO | NO | YES | NO | NO | YES | NO | NO | YES | YES | NO | YES | YES | YES | NO | | |
| L-Leucine | NO | NO | NO | YES | NO | YES | YES | YES | YES | YES | NO | NO | YES | YES | YES | | |
| 2,3-Butanediol | YES | NO | YES | NO | NO | NO | NO | NO | NO | NO | NO | NO | NO | NO | NO | | |
| Mannan | NO | NO | YES | NO | NO | NO | NO | NO | NO | NO | NO | NO | NO | NO | NO | | |
| D-Fucose | NO | NO | NO | NO | NO | NO | NO | NO | NO | NO | NO | NO | NO | NO | NO | | |
| β-Methyl-D-Xyloside | NO | YES | NO | NO | NO | NO | NO | NO | NO | YES | NO | NO | NO | NO | NO | | |
| d-amino valeric acid | NO | YES | YES | NO | NO | NO | YES | NO | YES | NO | NO | NO | NO | NO | NO | | |
| Itaconic acid | NO | NO | YES | NO | NO | NO | NO | NO | NO | YES | NO | NO | NO | NO | NO | | |
| D-Tartaric acid | NO | YES | NO | NO | NO | NO | NO | NO | NO | YES | NO | NO | NO | NO | NO | | |
| L-Lysine | NO | NO | YES | NO | NO | NO | YES | NO | YES | NO | YES | NO | NO | NO | | | |
| 2,3-Butanone | NO | NO | YES | NO | NO | NO | NO | NO | NO | YES | NO | NO | NO | NO | NO | | |
| Pectin | NO | YES | NO | YES | NO | NO | YES | NO | YES | NO | NO | NO | NO | NO | | | |
| 3-O-β-D-Galactopyranosyl-D-arabinose | NO | NO | YES | NO | NO | YES | NO | NO | YES | YES | NO | NO | NO | YES | | | |
| Palatinose | NO | NO | YES | YES | YES | NO | NO | YES | NO | YES | YES | YES | NO | NO | NO | | |
| Butyric acid | NO | YES | NO | NO | NO | NO | YES | NO | NO | NO | NO | NO | NO | NO | NO | | |
| 5-Keto-D-Gluconic acid | NO | NO | NO | NO | NO | NO | YES | NO | YES | NO | YES | NO | NO | NO | | | |
| L-Tartaric acid | NO | NO | YES | NO | NO | NO | YES | NO | NO | NO | NO | NO | NO | NO | NO | | |
| L-Methionine | NO | YES | NO | NO | NO | NO | NO | NO | NO | NO | NO | NO | NO | NO | NO | | |
| 3-Hydroxy 2-Butanone | NO | NO | NO | NO | NO | NO | NO | NO | YES | NO | NO | NO | NO | NO | | | |

| Strain/Substrate | SYM-135 | SYM-136 | SYM-151 | SYM-154 | SYM-15811 | SYM-15820 | SYM-15825 | SYM-15828 | SYM-15831 | SYM-15837 | SYM-15839 | SYM-15847 | SYM-15872 | SYM-15890 | SYM-15901 | SYM-15920 | SYM-15926 |
|---|---|---|---|---|---|---|---|---|---|---|---|---|---|---|---|---|---|
| N-acetyl-D-Galactosamine | NO | NO | NO | NO | NO | NO | NO | NO | NO | NO | NO | NO | NO | NO | NO | NO | NO |
| Gentiobiose | NO | YES | YES | NO | NO | NO | YES | NO | NO | NO | YES | YES | YES | NO | YES | YES | NO |
| D-Raffinose | YES | YES | YES | YES | YES | NO | NO | NO | YES | YES | YES | YES | YES | NO | YES | YES | NO |

TABLE 36F-continued

Substrate utilization as determined by BIOLOG PM2A MicroPlates by culturable fungi belonging to core OTUs.

| | | | | | | | | | | | | | | | | | |
|---|---|---|---|---|---|---|---|---|---|---|---|---|---|---|---|---|---|
| Capric acid | NO | NO | NO | NO | YES | NO | NO | NO | NO | NO | NO | NO | NO | NO | NO | NO | NO |
| D-lactic acid methyl ester | NO | NO | NO | NO | YES | NO | NO | NO | NO | NO | NO | NO | NO | NO | NO | NO | NO |
| Acetamide | NO | NO | NO | NO | NO | NO | NO | NO | NO | NO | NO | NO | NO | NO | NO | NO | NO |
| L-Ornithine | YES | NO | YES | NO | NO | YES | YES | YES | YES | YES | YES | YES | YES | YES | YES | YES | YES |
| Chondrointin sulfate C | NO | NO | NO | NO | NO | NO | NO | NO | NO | NO | NO | NO | YES | NO | NO | NO | NO |
| N-acetyl-neuraminic acid | NO | NO | NO | NO | NO | NO | NO | NO | NO | NO | NO | NO | NO | NO | NO | NO | NO |
| L-glucose | NO | NO | NO | NO | NO | NO | NO | NO | NO | NO | NO | NO | NO | NO | NO | NO | NO |
| Salicin | NO | NO | YES | NO | YES | NO | YES | NO | YES | NO | YES | YES | YES | NO | YES | YES | NO |
| Caproic acid | NO | NO | NO | NO | YES | NO | NO | NO | NO | NO | NO | NO | NO | NO | NO | NO | NO |
| Malonic acid | NO | NO | YES | NO | NO | NO | YES | NO | NO | YES | NO | NO | YES | NO | NO | NO | NO |
| L-Alanin-amide | NO | NO | YES | NO | YES | NO | YES | NO | NO | NO | NO | YES | YES | NO | NO | NO | NO |
| L-Phenyl-alanine | NO | NO | YES | NO | NO | NO | YES | NO | NO | NO | YES | YES | YES | NO | YES | YES | NO |
| a-Cyclo-dextrin | YES | YES | YES | YES | YES | NO | NO | YES | YES | YES | YES | YES | YES | YES | YES | YES | YES |
| β-D-allose | NO | NO | NO | NO | NO | NO | NO | NO | NO | NO | NO | NO | NO | NO | NO | NO | NO |
| Lactitol | NO | NO | NO | NO | YES | NO | NO | NO | NO | NO | NO | NO | NO | NO | NO | NO | NO |
| Sedoheptulosan | NO | NO | NO | NO | NO | NO | NO | NO | NO | NO | NO | YES | YES | NO | NO | NO | NO |
| Citraconic acid | NO | NO | NO | NO | NO | NO | NO | NO | NO | NO | NO | NO | NO | NO | NO | NO | NO |
| Melibionic acid | NO | NO | NO | NO | NO | NO | NO | NO | NO | NO | NO | NO | NO | NO | NO | NO | NO |
| N-Acetyl-L-Glutamic acid | NO | NO | NO | NO | NO | YES | NO | YES | NO | YES | NO | NO | NO | NO | NO | NO | YES |
| L-Pyro-glutamic acid | NO | YES | YES | NO | YES | YES | YES | YES | YES | YES | YES | YES | YES | YES | YES | YES | NO |
| B-Cyclo-dextrin | NO | NO | NO | NO | NO | NO | NO | NO | NO | NO | NO | NO | NO | NO | NO | NO | NO |
| Amygdalin | NO | NO | YES | NO | NO | NO | YES | NO | NO | YES | YES | YES | YES | NO | YES | YES | NO |
| D-Melezitose | YES | YES | YES | NO | YES | NO | YES | NO | YES | YES | YES | YES | YES | NO | YES | YES | NO |
| L-Sorbose | NO | YES | YES | NO | NO | NO | NO | NO | NO | YES | YES | NO | NO | NO | YES | NO | NO |
| Citramalic acid | NO | NO | NO | NO | NO | NO | NO | NO | NO | NO | NO | NO | NO | NO | NO | NO | NO |
| Oxalic acid | NO | YES | NO | NO | NO | NO | NO | NO | NO | NO | NO | YES | NO | NO | NO | NO | YES |
| L-Arginine | NO | NO | YES | NO | NO | YES | YES | YES | YES | YES | YES | YES | YES | NO | YES | YES | NO |
| L-Valine | NO | NO | NO | NO | NO | YES | YES | NO | YES | NO | YES | NO | YES | NO | YES | YES | YES |
| γ-Cyclo-dextrin | NO | YES | NO | NO | NO | NO | YES | NO | NO | NO | YES | NO | YES | NO | YES | YES | NO |
| D-arabinose | NO | NO | NO | NO | NO | NO | NO | NO | NO | NO | NO | NO | YES | NO | NO | NO | NO |
| Maltitol | NO | YES | YES | NO | NO | NO | YES | NO | NO | NO | NO | NO | YES | NO | YES | YES | YES |
| Stachyose | YES | YES | YES | NO | NO | NO | YES | NO | YES | YES | YES | YES | YES | NO | YES | YES | NO |
| D-Glucosamine | NO | NO | NO | NO | NO | NO | NO | NO | YES | YES | YES | NO | NO | NO | NO | NO | NO |
| Oxalomalic acid | NO | NO | NO | NO | NO | NO | NO | NO | NO | NO | NO | NO | NO | NO | NO | NO | NO |
| Glycine | NO | NO | NO | NO | YES | NO | YES | NO | NO | NO | NO | YES | YES | NO | YES | NO | NO |
| D,L-Carnitine | NO | NO | NO | NO | NO | NO | NO | YES | YES | NO | NO | NO | NO | NO | NO | NO | NO |
| Dextrin | YES | NO | YES | NO | YES | NO | YES | NO | YES | YES | YES | NO | YES | NO | YES | YES | YES |
| D-arabitol | YES | NO | YES | NO | NO | NO | YES | NO | NO | NO | NO | NO | YES | NO | YES | YES | NO |
| a-Methyl-D-Glucoside | NO | NO | NO | NO | NO | NO | NO | NO | NO | NO | NO | YES | NO | YES | NO | YES | NO |
| D-Tagatose | NO | NO | NO | NO | NO | NO | NO | NO | NO | NO | NO | NO | NO | NO | NO | NO | NO |
| 2-Hydroxy benzoic acid | NO | NO | NO | NO | NO | NO | NO | NO | NO | NO | NO | NO | NO | NO | NO | NO | NO |
| Quinic acid | NO | NO | YES | NO | YES | NO | YES | NO | NO | NO | YES | NO | YES | NO | NO | YES | NO |
| L-Histidine | NO | YES | NO | NO | YES | YES | YES | NO | NO | NO | YES | NO | YES | NO | YES | YES | YES |
| Sec-Butylamine | NO | NO | NO | NO | NO | NO | NO | NO | NO | NO | NO | NO | NO | NO | YES | NO | NO |
| Gelatin | NO | NO | YES | NO | NO | YES | YES | YES | NO | YES | YES | YES | YES | YES | YES | YES | YES |
| L-arabitol | NO | NO | NO | NO | NO | NO | NO | NO | NO | NO | NO | NO | YES | NO | NO | NO | NO |

TABLE 36F-continued

Substrate utilization as determined by BIOLOG PM2A MicroPlates by culturable fungi belonging to core OTUs.

| | | | | | | | | | | | | | | | | |
|---|---|---|---|---|---|---|---|---|---|---|---|---|---|---|---|---|
| β-Methyl-D-Galactoside | NO | YES | NO | NO | NO | NO | NO | NO | NO | YES | NO | NO | YES | NO | NO | NO | NO |
| Turanose | YES | YES | YES | YES | NO | NO | YES | NO | YES | YES | YES | YES | YES | NO | YES | YES | NO |
| 4-Hydroxy benzoic acid | NO | NO | NO | NO | NO | NO | NO | NO | NO | NO | NO | NO | YES | NO | NO | NO | NO |
| D-Ribono-1,4-Lactone | NO | NO | NO | NO | YES | NO | NO | NO | NO | NO | NO | NO | NO | NO | NO | NO | NO |
| L-Homoserine | NO | NO | NO | NO | NO | NO | NO | NO | NO | NO | NO | NO | NO | NO | NO | NO | NO |
| D,L-Octopamine | NO | NO | NO | NO | YES | YES | NO | YES | NO | YES | NO | NO | YES | YES | NO | NO | NO |
| Glycogen | NO | YES | YES | NO | NO | NO | YES | NO | YES | YES | YES | YES | YES | NO | YES | YES | NO |
| Arbutin | NO | YES | YES | NO | NO | NO | YES | NO | NO | YES | YES | YES | YES | NO | YES | YES | NO |
| 3-Methyl Glucose | NO | NO | NO | NO | NO | NO | NO | NO | NO | NO | NO | NO | NO | NO | NO | NO | NO |
| Xylitol | NO | NO | NO | NO | YES | NO | NO | NO | NO | NO | NO | NO | YES | NO | NO | NO | NO |
| β-Hydroxy butyric acid | NO | NO | YES | NO | NO | NO | NO | NO | NO | NO | NO | NO | NO | YES | YES | YES | NO |
| Sebacic acid | NO | NO | NO | NO | NO | NO | YES | NO | NO | YES | NO | NO | YES | NO | NO | NO | NO |
| Hydroxy-L-Proline | NO | NO | YES | NO | YES | YES | YES | YES | YES | YES | YES | YES | YES | YES | YES | YES | YES |
| Putrescine | YES | YES | YES | NO | NO | NO | YES | YES | NO | NO | YES | YES | YES | NO | YES | YES | NO |
| Inulin | NO | NO | NO | NO | NO | NO | NO | NO | NO | NO | YES | NO | NO | YES | NO | NO | NO |
| 2-Deoxy-D-Ribose | NO | NO | NO | NO | NO | NO | NO | NO | NO | NO | NO | NO | NO | NO | NO | NO | NO |
| β-Methyl-D-Glucuronic acid | NO | NO | NO | NO | NO | NO | NO | NO | NO | NO | NO | NO | YES | NO | NO | NO | YES |
| N-Acetyl-D-glucosaminitol | NO | NO | NO | NO | NO | NO | NO | NO | NO | NO | NO | NO | NO | NO | NO | NO | NO |
| γ-Hydroxy butyric acid | NO | NO | NO | NO | YES | NO | NO | NO | NO | NO | NO | NO | NO | NO | NO | NO | NO |
| Sorbic acid | NO | NO | NO | NO | NO | NO | NO | NO | NO | NO | NO | NO | NO | NO | NO | NO | NO |
| L-Isoleucine | NO | NO | YES | NO | NO | YES | YES | YES | YES | YES | YES | YES | YES | NO | YES | YES | NO |
| Dihydroxy acetone | NO | NO | NO | NO | NO | NO | NO | NO | NO | NO | NO | NO | NO | NO | NO | NO | NO |
| Laminarin | NO | NO | YES | NO | NO | NO | NO | NO | NO | NO | YES | NO | NO | YES | NO | YES | NO |
| i-Erythritol | NO | NO | NO | NO | NO | NO | NO | NO | NO | YES | NO | NO | NO | NO | NO | NO | NO |
| a-Methyl-D-Mannoside | NO | NO | NO | NO | NO | NO | NO | NO | NO | NO | NO | NO | NO | NO | NO | NO | NO |
| γ-amino butyric acid | NO | YES | YES | NO | YES | NO | YES | NO | YES | YES | YES | YES | YES | NO | YES | YES | YES |
| a-Keto-valeric acid | NO | NO | NO | NO | NO | NO | NO | NO | YES | NO | NO | YES | YES | NO | NO | NO | NO |
| Succinamic acid | NO | NO | NO | NO | NO | NO | YES | NO | YES | NO | YES | YES | NO | YES | NO | NO | NO |
| L-Leucine | NO | NO | YES | YES | NO | NO | YES | NO | NO | YES | YES | YES | YES | NO | YES | YES | NO |
| 2,3-Butanediol | NO | NO | NO | NO | NO | NO | NO | NO | NO | NO | NO | YES | NO | NO | NO | NO | NO |
| Mannan | NO | NO | NO | NO | NO | NO | NO | NO | NO | NO | NO | NO | NO | NO | NO | NO | NO |
| D-Fucose | NO | NO | NO | NO | NO | NO | NO | NO | NO | NO | NO | NO | NO | NO | NO | NO | NO |
| β-Methyl-D-Xyloside | NO | NO | NO | NO | NO | NO | NO | NO | NO | NO | NO | NO | NO | NO | NO | NO | NO |
| d-amino valeric acid | NO | NO | NO | NO | NO | NO | NO | NO | NO | YES | YES | NO | YES | NO | NO | NO | YES |
| Itaconic acid | NO | NO | NO | NO | YES | NO | NO | NO | YES | NO | NO | NO | NO | NO | NO | NO | YES |
| D-Tartaric acid | NO | NO | NO | NO | NO | NO | NO | NO | NO | NO | NO | NO | NO | NO | NO | NO | NO |
| L-Lysine | NO | NO | YES | NO | NO | NO | YES | NO | YES | YES | NO | YES | YES | NO | YES | NO | NO |
| 2,3-Butanone | NO | NO | NO | NO | NO | NO | NO | NO | NO | NO | NO | NO | NO | NO | NO | NO | NO |
| Pectin | NO | NO | YES | NO | NO | NO | YES | YES | YES | NO | YES | NO | YES | NO | NO | YES | YES |
| 3-O-β-D-Galactopyranosyl-D-arabinose | NO | NO | NO | NO | NO | NO | YES | NO | NO | NO | NO | NO | YES | NO | NO | NO | NO |
| Palatinose | YES | YES | YES | NO | YES | NO | YES | NO | YES | YES | YES | YES | YES | YES | YES | YES | NO |
| Butyric acid | NO | NO | NO | NO | YES | NO | YES | YES | NO | YES | NO | NO | YES | NO | YES | YES | NO |
| 5-Keto-D-Gluconic acid | NO | NO | NO | NO | NO | NO | NO | NO | NO | NO | NO | NO | NO | YES | NO | NO | NO |
| L-Tartaric acid | NO | NO | YES | NO | YES | NO | NO | NO | NO | NO | NO | YES | NO | YES | YES | NO | NO |

TABLE 36F-continued

Substrate utilization as determined by BIOLOG PM2A MicroPlates by culturable fungi belonging to core OTUs.

| | | | | | | | | | | | | | | | | | |
|---|---|---|---|---|---|---|---|---|---|---|---|---|---|---|---|---|---|
| L-Methionine | NO | NO | NO | NO | NO | NO | NO | NO | NO | NO | NO | NO | NO | NO | NO | NO | NO |
| 3-Hydroxy 2-Butanone | NO | NO | NO | NO | NO | NO | NO | NO | NO | NO | NO | NO | NO | NO | NO | NO | |

| Strain/Substrate | SYM-15928 | SYM-15932 | SYM-160 | SYM-34 | SYM-566B | SYM-577 | SYM-590 | SYM-603 | SYM-61A | SYM-622 | SYM-629 | SYM-66 | SYM-663 | SYM-696 | SYM-741A | SYM-741B | SYM-854 | SYM-880 |
|---|---|---|---|---|---|---|---|---|---|---|---|---|---|---|---|---|---|---|
| N-acetyl-D-Galactosamine | NO | NO | NO | NO | NO | NO | NO | NO | NO | NO | NO | NO | NO | NO | NO | NO | NO | YES |
| Gentiobiose | YES | YES | YES | YES | NO | YES | YES | NO | YES | NO | NO | NO | NO | YES | YES | NO | NO | NO |
| D-Raffinose | YES | YES | YES | NO | NO | YES | NO | NO | YES | NO | NO | YES | NO | YES | YES | NO | YES | NO |
| Capric acid | NO | NO | NO | NO | NO | NO | NO | YES | NO | NO | NO | NO | NO | NO | NO | NO | NO | NO |
| D-lactic acid methyl ester | NO | NO | NO | NO | NO | NO | NO | NO | NO | NO | NO | NO | NO | NO | NO | NO | NO | NO |
| Acetamide | NO | NO | NO | NO | NO | NO | NO | NO | NO | NO | NO | NO | NO | YES | NO | NO | NO | YES |
| L-Ornithine | YES | YES | NO | YES | YES | YES | YES | YES | YES | YES | NO | YES | YES | YES | YES | NO | NO | |
| Chondroitin sulfate C | NO | YES | NO | NO | NO | NO | NO | NO | NO | NO | NO | NO | NO | YES | YES | NO | NO | NO |
| N-acetyl-neuraminic acid | NO | NO | NO | NO | NO | NO | NO | NO | NO | NO | NO | NO | NO | NO | NO | NO | NO | YES |
| L-glucose | NO | NO | NO | NO | NO | NO | NO | NO | NO | NO | NO | NO | NO | NO | YES | NO | NO | NO |
| Salicin | YES | YES | YES | YES | NO | YES | YES | NO | YES | NO | NO | NO | NO | YES | NO | NO | NO | NO |
| Caproic acid | NO | NO | NO | NO | NO | NO | NO | NO | NO | NO | NO | NO | NO | YES | NO | NO | NO | NO |
| Malonic acid | NO | NO | NO | NO | YES | NO | NO | NO | YES | NO | NO | NO | NO | NO | NO | NO | NO | NO |
| L-Alaninamide | NO | NO | NO | YES | NO | YES | NO | YES | YES | NO | NO | NO | NO | YES | NO | YES | NO | YES |
| L-Phenylalanine | NO | NO | NO | NO | NO | YES | NO | YES | NO | NO | NO | NO | NO | NO | YES | NO | NO | NO |
| α-Cyclodextrin | YES | YES | YES | YES | YES | NO | NO | YES | YES | YES | NO | YES | NO | NO | NO | YES | NO | YES |
| β-D-allose | YES | NO | NO | NO | NO | NO | NO | NO | NO | NO | NO | NO | NO | YES | NO | NO | NO | YES |
| Lactitol | NO | NO | NO | NO | NO | NO | NO | NO | YES | NO | NO | NO | NO | YES | YES | NO | NO | YES |
| Sedoheptulosan | NO | NO | NO | NO | NO | NO | NO | NO | NO | NO | NO | NO | NO | NO | YES | NO | NO | YES |
| Citraconic acid | NO | NO | NO | NO | NO | NO | NO | NO | NO | NO | NO | NO | NO | YES | NO | NO | NO | YES |
| Melibionic acid | NO | NO | NO | NO | NO | YES | NO | YES | NO | NO | NO | NO | NO | YES | NO | NO | NO | NO |
| N-Acetyl-L-Glutamic acid | NO | NO | NO | NO | NO | NO | YES | NO | YES | YES | NO | NO | YES | NO | YES | NO | YES | |
| L-Pyroglutamic acid | YES | NO | NO | YES | YES | YES | NO | YES | YES | YES | NO | NO | YES | NO | YES | YES | YES | YES |
| β-Cyclodextrin | NO | YES | YES | NO | NO | NO | NO | NO | NO | NO | NO | NO | NO | NO | YES | NO | NO | Y |
| Amygdalin | NO | YES | NO | YES | NO | YES | NO | NO | NO | NO | NO | NO | NO | NO | YES | NO | YES | YES |
| D-Melezitose | YES | YES | YES | YES | NO | YES | NO | NO | YES | NO | NO | NO | NO | YES | YES | NO | NO | YES |
| L-Sorbose | NO | NO | NO | NO | YES | NO | NO | NO | NO | NO | NO | NO | NO | NO | YES | NO | NO | NO |
| Citramalic acid | NO | NO | NO | NO | NO | NO | NO | NO | NO | NO | NO | NO | NO | NO | NO | NO | NO | YES |
| Oxalic acid | NO | YES | NO | NO | NO | NO | NO | NO | NO | NO | NO | NO | NO | YES | NO | NO | NO | YES |
| L-Arginine | YES | YES | NO | YES | NO | YES | NO | YES | YES | YES | YES | NO | YES | YES | YES | YES | YES | YES |
| L-Valine | NO | NO | NO | YES | NO | YES | NO | YES | NO | YES | YES | NO | NO | YES | YES | YES | NO | YES |
| γ-Cyclodextrin | YES | YES | YES | NO | NO | YES | NO | NO | YES | NO | NO | NO | NO | YES | NO | NO | YES | NO |
| D-arabinose | NO | NO | NO | NO | NO | NO | NO | NO | NO | NO | NO | NO | NO | YES | NO | NO | NO | NO |
| Maltitol | YES | YES | YES | NO | NO | YES | NO | NO | NO | NO | YES | NO | NO | YES | YES | NO | YES | YES |
| Stachyose | YES | YES | YES | NO | NO | YES | NO | NO | YES | NO | YES | NO | NO | YES | YES | NO | YES | YES |
| D-Glucosamine | NO | NO | NO | YES | NO | YES | NO | YES | NO | YES | NO | NO | NO | NO | NO | NO | NO | NO |
| Oxalomalic acid | NO | NO | NO | NO | NO | NO | NO | NO | NO | NO | NO | NO | NO | NO | NO | NO | NO | NO |
| Glycine | NO | NO | NO | NO | NO | NO | NO | NO | NO | NO | NO | NO | NO | YES | YES | NO | NO | YES |
| D,L-Carnitine | NO | NO | NO | NO | NO | NO | NO | YES | NO | YES | NO | NO | NO | NO | NO | YES | NO | NO |

TABLE 36F-continued

Substrate utilization as determined by BIOLOG PM2A MicroPlates by culturable fungi belonging to core OTUs.

| Substrate | | | | | | | | | | | | | | | | | |
|---|---|---|---|---|---|---|---|---|---|---|---|---|---|---|---|---|---|
| Dextrin | YES | YES | YES | YES | NO | YES | NO | NO | YES | NO | NO | NO | NO | YES | YES | NO | YES | YES |
| D-arabitol | YES | NO | NO | YES | NO | YES | NO | NO | YES | NO | YES | NO | NO | YES | YES | NO | YES | NO |
| a-Methyl-D-Glucoside | YES | NO | YES | NO | NO | NO | NO | NO | NO | NO | NO | NO | NO | NO | YES | NO | NO | NO |
| D-Tagatose | NO | NO | NO | NO | NO | NO | NO | NO | NO | NO | NO | YES | NO | NO | NO | NO | NO | NO |
| 2-Hydroxy benzoic acid | NO | NO | NO | NO | NO | NO | NO | NO | NO | NO | NO | NO | NO | YES | YES | NO | NO | NO |
| Quinic acid | NO | YES | NO | YES | NO | NO | NO | YES | NO | NO | NO | NO | NO | YES | NO | NO | NO | YES |
| L-Histidine | NO | NO | NO | NO | YES | YES | NO | YES | YES | YES | NO | NO | NO | YES | NO | YES | NO | NO |
| Sec-Butylamine | NO | NO | NO | NO | NO | NO | NO | NO | NO | NO | NO | NO | NO | NO | NO | NO | NO | NO |
| Gelatin | YES | YES | NO | YES | NO | YES | YES | NO | YES | NO | NO | NO | NO | YES | YES | YES | YES | NO |
| L-arabitol | NO | YES | NO | NO | NO | NO | NO | NO | YES | NO | NO | NO | NO | YES | NO | NO | NO | YES |
| β-Methyl-D-Galactoside | NO | YES | NO | YES | NO | NO | NO | NO | YES | NO | NO | NO | NO | YES | NO | NO | NO | NO |
| Turanose | YES | YES | YES | YES | NO | YES | NO | NO | YES | NO | NO | NO | NO | YES | NO | NO | YES | YES |
| 4-Hydroxy benzoic acid | NO | NO | NO | NO | NO | NO | NO | NO | YES | NO | NO | NO | NO | YES | NO | NO | NO | YES |
| D-Ribono-1,4-Lactone | NO | NO | NO | NO | NO | NO | NO | NO | NO | NO | NO | NO | YES | YES | NO | NO | YES | YES |
| L-Homoserine | NO | NO | NO | NO | NO | NO | NO | NO | YES | NO | NO | NO | NO | NO | NO | NO | NO | NO |
| D,L-Octopamine | NO | NO | NO | NO | NO | YES | NO | YES | YES | YES | YES | NO | NO | NO | YES | YES | YES | NO |
| Glycogen | YES | YES | YES | YES | NO | YES | YES | NO | YES | YES | NO | NO | YES | YES | YES | NO | YES | YES |
| Arbutin | YES | YES | YES | YES | NO | YES | YES | NO | YES | NO | NO | NO | NO | YES | YES | YES | YES | YES |
| 3-Methyl Glucose | NO | NO | NO | NO | NO | NO | NO | NO | NO | NO | NO | NO | NO | NO | YES | NO | NO | NO |
| Xylitol | NO | NO | YES | NO | YES | NO | NO | NO | NO | NO | NO | NO | NO | NO | NO | NO | NO | YES |
| β-Hydroxy butyric acid | YES | NO | NO | NO | YES | YES | NO | NO | NO | NO | NO | NO | NO | YES | YES | NO | NO | NO |
| Sebacic acid | NO | NO | NO | NO | NO | NO | NO | YES | YES | NO | NO | NO | NO | NO | NO | NO | NO | NO |
| Hydroxy-L-Proline | NO | NO | NO | NO | YES | YES | YES | YES | YES | YES | YES | NO | YES | NO | YES | YES | YES | YES |
| Putrescine | YES | NO | NO | YES | NO | YES | NO | YES | YES | NO | NO | NO | NO | YES | YES | NO | NO | YES |
| Inulin | YES | NO | NO | NO | NO | NO | YES | NO | NO | YES | YES | NO | NO | YES | YES | YES | NO | YES |
| 2-Deoxy-D-Ribose | NO | NO | NO | NO | NO | NO | NO | NO | NO | NO | NO | NO | NO | NO | NO | NO | NO | NO |
| β-Methyl-D-Glucuronic acid | NO | YES | NO | NO | NO | NO | NO | NO | YES | NO | NO | NO | NO | YES | NO | NO | NO | NO |
| N-Acetyl-D-gluco-saminitol | NO | NO | NO | NO | NO | NO | NO | NO | NO | NO | NO | NO | NO | YES | NO | NO | NO | YES |
| γ-Hydroxy butyric acid | NO | NO | NO | NO | NO | NO | NO | YES | NO | NO | NO | NO | NO | YES | NO | NO | NO | NO |
| Sorbic acid | NO | NO | NO | NO | YES | NO | NO | NO | YES | NO | NO | NO | NO | NO | NO | NO | NO | NO |
| L-Isoleucine | NO | YES | NO | YES | NO | YES | NO | YES | NO | YES | YES | NO | NO | YES | YES | YES | NO | YES |
| Dihydroxy acetone | NO | NO | NO | NO | NO | NO | NO | NO | NO | NO | NO | NO | NO | NO | NO | NO | NO | NO |
| Laminarin | NO | NO | NO | YES | NO | NO | NO | NO | YES | NO | NO | NO | NO | NO | NO | NO | NO | NO |
| i-Erythritol | YES | NO | NO | YES | NO | NO | YES | NO | NO | NO | YES | NO | NO | YES | NO | YES | YES | NO |
| a-Methyl-D-Mannoside | NO | NO | NO | NO | NO | NO | NO | NO | NO | NO | NO | NO | NO | YES | NO | NO | NO | NO |
| γ-amino butyric acid | YES | NO | NO | YES | NO | YES | YES | YES | YES | YES | YES | NO | NO | YES | YES | YES | YES | YES |
| a-Keto-valeric acid | NO | YES | NO | NO | YES | NO | NO | NO | YES | NO | YES | NO | NO | YES | NO | NO | NO | YES |
| Succinamic acid | NO | NO | NO | YES | NO | YES | NO | NO | YES | NO | NO | NO | NO | YES | YES | NO | YES | YES |
| L-Leucine | NO | NO | NO | YES | NO | YES | NO | YES | NO | YES | YES | NO | NO | NO | YES | YES | NO | NO |
| 2,3-Butanediol | NO | NO | NO | NO | NO | NO | NO | NO | YES | NO | NO | NO | NO | YES | NO | NO | NO | YES |
| Mannan | NO | NO | NO | NO | NO | NO | NO | NO | NO | NO | NO | NO | NO | YES | NO | NO | NO | YES |
| D-Fucose | NO | YES | NO | NO | NO | NO | NO | NO | NO | NO | NO | NO | NO | YES | NO | NO | NO | YES |
| β-Methyl-D-Xyloside | NO | NO | NO | NO | NO | NO | NO | NO | NO | NO | NO | NO | NO | NO | NO | NO | NO | NO |
| d-amino valeric acid | NO | NO | NO | NO | YES | NO | NO | NO | NO | NO | NO | NO | NO | NO | NO | NO | NO | NO |
| Itaconic acid | NO | NO | NO | NO | NO | NO | NO | NO | NO | NO | NO | NO | NO | YES | NO | NO | NO | NO |
| D-Tartaric acid | NO | NO | NO | NO | NO | NO | NO | NO | NO | NO | NO | NO | NO | YES | NO | NO | NO | NO |

TABLE 36F-continued

Substrate utilization as determined by BIOLOG PM2A MicroPlates by culturable fungi belonging to core OTUs.

| | | | | | | | | | | | | | | | | | | |
|---|---|---|---|---|---|---|---|---|---|---|---|---|---|---|---|---|---|---|
| L-Lysine | NO | NO | NO | YES | YES | NO | NO | NO | YES | NO | NO | NO | NO | YES | YES | NO | NO | YES |
| 2,3-Butanone | NO | NO | NO | NO | NO | NO | NO | NO | NO | NO | NO | NO | NO | NO | NO | NO | NO | NO |
| Pectin | YES | YES | YES | YES | NO | YES | NO | NO | YES | NO | NO | NO | NO | YES | YES | NO | YES | YES |
| 3-0-β-D-Galacto-pyranosyl-D-arabinose | NO | NO | NO | NO | NO | YES | NO | NO | NO | NO | NO | NO | NO | YES | YES | YES | NO | YES |
| Palatinose | YES | YES | YES | YES | NO | YES | YES | NO | NO | NO | NO | NO | YES | YES | YES | NO | YES | YES |
| Butyric acid | NO | NO | NO | NO | NO | NO | NO | NO | YES | NO | NO | NO | NO | NO | NO | NO | YES | NO |
| 5-Keto-D-Gluconic acid | NO | NO | NO | NO | NO | NO | NO | NO | NO | NO | NO | NO | NO | YES | NO | NO | NO | NO |
| L-Tartaric acid | NO | YES | NO | NO | NO | YES | NO | NO | YES | NO | NO | NO | NO | NO | NO | NO | NO | NO |
| L-Methionine | NO | NO | YES | NO | NO | NO | NO | NO | NO | NO | NO | NO | NO | NO | NO | NO | NO | NO |
| 3-Hydroxy 2-Butanone | NO | NO | NO | NO | NO | NO | NO | NO | NO | NO | NO | NO | YES | NO | NO | NO | NO | NO |

Example 9

Testing of Culturable Bacterial and Fungal Endophytes Belonging to Core OTUs on Plants The results shown above demonstrate that culturable microbes belonging to the same OTUs as microbes core to wheat, soy, cotton, and corn (bacteria) or wheat, cotton, and corn (fungi) possess activities that could impart beneficial traits to a plant upon colonization. The aim of the experiments in this section addresses the ability of these culturable bacterial and fungal endophytes to confer beneficial traits on a host plant. Several different methods were used to ascertain this. First, plants inoculated with bacteria or fungi were tested under conditions without any stress to determine whether the microbe confers an increase in vigor. Second, endophyte-inoculated plants were tested under specific stress conditions (e.g., salt stress or drought stress) to test whether the bacteria confer an increase in tolerance to these stresses. These growth tests were performed using three different means: using growth assays on water-agar plates; using growth assays on sterile filter papers; and growth assays in seed germination (rolling) paper. Seeds were treated either with a single bacterial or fungal strain, or with a combination of two bacterial or two fungal strains.

Seeds and Seed Sterilization

Seeds from soy, corn or wheat were surface-sterilized with chlorine gas and hydrochloric acid as described in Example 5. The seeds were then coated with bacterial or fungal endophytes as described in Example 5. However, the amount of Sodium Alginate and bacterial suspension or fungal inoculum was adjusted for wheat to 15 ml/kg to account for the larger surface to volume ratio of these small seeds.

Growth & Scale-Up of Fungi for Inoculation

Fungal isolates were grown from a frozen stock on Petri dishes containing potato dextrose agar and the plates were incubated at room temperature for about a week. After mycelia and spore development, four agar plugs (1 cm in diameter) were used to inoculate erlenmeyers containing 150 ml of potato dextrose broth. Liquid cultures were grown at room temperature and agitation on an orbital shaker at 115 rpm for 4 days. Then, the cultures were transferred to 50 ml sterile test tubes with conical bottoms. Mycelium mats were disrupted by pulse sonication at 75% setting and 3 pulses of 20 seconds each, using a Fisher Scientific sonicator (Model FB120) with a manual probe (CL-18). The sonicated cultures were used in the same manner as the bacterial suspensions for seed inoculation.

Water Agar Assays

Bacterial or fungal endophytes belonging to OTUs of core microbes were tested for their ability to promote plant growth under normal and salt-stressed or drought-stressed conditions by inoculating wheat and soy seeds with those endophytes and germinating them on filter paper and/or water agar For testing the effect of the endophytes on soy under salt stress, treated soy seeds were placed on Petri dishes (15 cm in diameter) filled with 50 ml of water agar (1.3% bacto agar) for the normal condition and filled with 50 ml of water agar with 100 mM NaCl for salt stress. Three Petri dishes per treatment (each bacterial strain, formulation control or non treated seeds) and 8 seeds per Petri dish were used. The seeds were placed on the Petri dishes inside a laminar or biosafety hood using forceps previously flamed. The Petri dishes were sealed with surgical tape, randomized to avoid position effects and placed in a growth chamber set at 22° C., 60% relative humidity, in the dark for five days.

For testing the effect of salt stress on wheat, a water agar assay was performed using square plates 245 mm long on each side (Corning). Each plate contained 100 ml of water agar (1.3%) for the normal condition and supplemented with 100 mM NaCl for the salt stress. Two plates were used per treatment and the seeds were arranged in two rows of 6 seeds each along the middle of the plate, with the embryos facing outwardly so that the roots would grow from the middle of the plate outwardly and in opposite directions, minimizing roots crossing over among seedlings.

After 5 days of growth, digital images of the seedlings were obtained and the data scored and analyzed as indicated in Example 5. The effects of core bacterial and fungal endophytes, alone or in combination, on soy seedlings are shown in Tables 37A and B and 38A and B. The effects of core bacterial and fungal endophytes, alone or in combination, on wheat seedlings are shown in Tables 39A and B and 40A and B.

TABLE 37A

Assay for soy seedling growth in water agar conditions, where soy seeds were treated with core bacterial endophytes.

| Strain | SEQ ID NO. | Normal | Biological Effect? | Salt | Biological Effect? |
|---|---|---|---|---|---|
| SYM00009 | 3589 | 1 | yes | 0 | no |
| SYM00013 | 3590 | 0 | no | — | — |

TABLE 37A-continued

Assay for soy seedling growth in water agar conditions, where soy seeds were treated with core bacterial endophytes.

| Strain | SEQ ID NO. | Normal | Biological Effect? | Salt | Biological Effect? |
|---|---|---|---|---|---|
| SYM00018 | 3592 | 0 | yes | — | — |
| SYM00020 | 3593 | 1 | yes | — | — |
| SYM00053 | 3601 | 0 | yes | 0 | yes |
| SYM00062C | 3603 | 0 | yes | — | — |
| SYM00070 | 3607 | 0 | yes | 0 | yes |
| SYM00103 | 3609 | 0 | yes | 0 | yes |
| SYM00184 | 3621 | 0 | no | 1 | no |
| SYM00212 | 3623 | 2 | yes | 1 | yes |
| SYM00234 | 3625 | 1 | yes | 0 | yes |
| SYM00249 | 3628 | 0 | no | 0 | no |
| SYM00506c | 3629 | 1 | no | 0 | yes |
| SYM00507 | 3630 | 1 | yes | 0 | no |
| SYM00508 | 3631 | 0 | yes | 0 | yes |
| SYM00525 | 3632 | 1 | no | 0 | yes |
| SYM00538A | 3633 | 0 | no | 0 | no |
| SYM00538B | 3634 | 0 | yes | 0 | no |
| SYM00538i | 3635 | 1 | no | 0 | yes |
| SYM00617 | 3645 | 0 | yes | 0 | yes |
| SYM00620 | 3646 | 0 | yes | 1 | yes |
| SYM00628 | 3649 | 0 | yes | — | — |
| SYM00650 | 3652 | 0 | yes | 0 | no |
| SYM00714 | 3656 | 0 | yes | 1 | no |
| SYM00905 | 3663 | 0 | yes | 0 | yes |
| SYM00924 | 3664 | 0 | no | 0 | yes |
| SYM00963 | 3665 | 1 | yes | 0 | no |
| SYM00982 | 3666 | 1 | yes | 0 | no |
| SYM00987 | 3667 | 0 | yes | 0 | no |

Legend: 0 indicates <0% effect, 1 indicates <20% effect, 2 indicates <40% effect, 3 indicates >40% effect.
For Biological Effect: yes indicates >5% or <−5% effect, no indicates effect between −5% and +5%.

Soy seedlings treated with SYM00009, SYM00020, SYM00212, SYM00234, SYM00506c, SYM00507, SYM00525, SYM00538i, SYM00963, and SYM00982 showed overall better performance relative to formulation only treated plants. These strains performed up to 40% improvement in normal conditions. Under salt stress conditions, four SYM strains performed up to 20% better relative to formulation only. These data is indicative of the beneficial effects of the many core bacterial SYM strains on soy under both normal and biotic stressed conditions.

Based on BIOLOG carbon source assays, SYM00212 that is one of the strains that conferred beneficial effects on soy are also able to use L-proline as a single source of carbon. It is well established that endogenous proline level is elevated in plants undergoing drought and salt stresses (Chen and Murata, 2002). This phenomenon may facilitate more nutrients to become available for endophytes living symbiotically with plant hosts exposed to abiotic stresses. Therefore it could be possible that the ability for endophytes like SYM00212 to scavenge and utilize accumulated amino acids such as proline is associated with its ability to confer beneficial effects on the plant host.

TABLE 37B

Assay for soy seedling growth in water agar conditions, where soy seeds were treated with combinations of core bacterial endophytes.

| Strain | SEQ ID NO. | Strain | SEQ ID NO. | Normal | Biological Effect? | Salt stress | Biological Effect? |
|---|---|---|---|---|---|---|---|
| SYM00050 | 3600 | SYM00053 | 3601 | 2 | yes | 1 | no |
| SYM00050 | 3600 | SYM00207 | 3622 | 1 | yes | 1 | yes |
| SYM00050 | 3600 | SYM00248 | 3627 | 1 | yes | 1 | yes |
| SYM00050 | 3600 | SYM00508 | 3631 | 1 | yes | — | — |
| SYM00050 | 3600 | SYM00574 | 3641 | 1 | no | 1 | no |
| SYM00050 | 3600 | SYM00978 | 3668 | 0 | yes | 0 | yes |
| SYM00050 | 3600 | SYM00991 | 3669 | 1 | yes | 0 | no |
| SYM00053 | 3601 | SYM00207 | 3622 | 1 | yes | 1 | no |
| SYM00053 | 3601 | SYM00248 | 3627 | 0 | no | 0 | no |
| SYM00053 | 3601 | SYM00508 | 3631 | 2 | yes | 1 | yes |
| SYM00053 | 3601 | SYM00574 | 3641 | 0 | yes | 0 | no |
| SYM00053 | 3601 | SYM00628 | 3649 | 1 | yes | 1 | no |
| SYM00053 | 3601 | SYM00978 | 3668 | — | — | 0 | no |
| SYM00053 | 3601 | SYM00991 | 3669 | 2 | yes | 0 | no |
| SYM00053 | 3601 | SYM01049 | 3671 | 0 | yes | 1 | no |
| SYM00207 | 3622 | SYM00248 | 3627 | 1 | yes | 0 | no |
| SYM00207 | 3622 | SYM00508 | 3631 | 1 | yes | 0 | no |
| SYM00207 | 3622 | SYM00628 | 3649 | 2 | yes | 1 | no |
| SYM00207 | 3622 | SYM00978 | 3668 | 1 | no | — | — |
| SYM00207 | 3622 | SYM00991 | 3669 | 1 | yes | 1 | yes |
| SYM00207 | 3622 | SYM01049 | 3671 | 0 | yes | 1 | no |
| SYM00248 | 3627 | SYM00574 | 3641 | 0 | yes | — | — |
| SYM00248 | 3627 | SYM00628 | 3649 | 1 | yes | 1 | no |
| SYM00248 | 3627 | SYM00991 | 3669 | 0 | no | 1 | no |
| SYM00248 | 3627 | SYM01049 | 3671 | 0 | yes | 0 | no |
| SYM00508 | 3631 | SYM00574 | 3641 | 0 | no | 0 | no |
| SYM00508 | 3631 | SYM00991 | 3669 | 1 | yes | 0 | yes |
| SYM00508 | 3631 | SYM01049 | 3671 | — | — | 1 | yes |
| SYM00574 | 3641 | SYM00628 | 3649 | 1 | yes | 1 | no |
| SYM00574 | 3641 | SYM00978 | 3668 | 1 | yes | 0 | no |
| SYM00574 | 3641 | SYM00991 | 3669 | 1 | no | 0 | no |
| SYM00574 | 3641 | SYM01049 | 3671 | 0 | yes | 0 | no |

TABLE 37B-continued

Assay for soy seedling growth in water agar conditions, where soy seeds were treated with combinations of core bacterial endophytes.

| Strain | SEQ ID NO. | Strain | SEQ ID NO. | Normal | Biological Effect? | Salt stress | Biological Effect? |
|---|---|---|---|---|---|---|---|
| SYM00628 | 3649 | SYM00978 | 3668 | 0 | yes | 1 | no |
| SYM00628 | 3649 | SYM00991 | 3669 | 2 | yes | 0 | no |
| SYM00991 | 3669 | SYM00978 | 3668 | 0 | yes | 0 | yes |
| SYM00991 | 3669 | SYM01049 | 3671 | 0 | yes | 0 | no |
| SYM01049 | 3671 | SYM00978 | 3668 | 0 | yes | 0 | yes |

Legend: 0 indicates <0% effect, 1 indicates <20% effect, 2 indicates <40% effect, 3 indicates <40% effect.
For Biological Effect: yes indicates >5% or <−5% effect, no indicates effect between −5% and +5%.

Under normal conditions, 12.8% of core bacteria combinations applied to soy seeds resulted in >20% improvement in overall seedling phenotype compared to the formulation-only treatment. In particular, core bacterial strains SYM00053, SYM00207, and SYM00628 each provided two combinations with other strains that improved the measured phenotype by >20% as compared to the formulation-only treatment. In combination, these strains seem to synergistically confer benefits towards plant development. 46.8% of core bacteria combinations resulted in a >5% positive biological effect, and 29.8% of core bacteria combinations resulted in a >5% negative biological effect as compared to formulation-only treatment, indicating activity of the bacterial strains in the seed's early developmental stages.

Under salt stress, 14.9% of core bacteria combinations applied to soy seeds resulted in a >5% positive biological effect, and 14.9% of core bacteria combinations resulted in a >5% negative biological effect as compared to formulation-only treatment, indicating activity of the bacterial strains in the seed's early developmental stages.

TABLE 38A

Assay for soy seedling growth in water agar conditions, where soy seeds were treated with core fungal endophytes.

| Strain | SEQ ID NO. | Normal | Biological Effect? | Salt | Biological Effect? |
|---|---|---|---|---|---|
| SYM00034 | 3597 | 0 | yes | 1 | no |
| SYM00061A | 3602 | 0 | yes | 0 | yes |
| SYM00066 | 3605 | 3 | yes | 1 | yes |
| SYM00120 | 3610 | 0 | yes | 0 | yes |
| SYM00122 | 3611 | 3 | yes | 0 | yes |
| SYM00123 | 3612 | 0 | yes | — | — |
| SYM00124 | 3613 | 0 | no | 1 | no |
| SYM00129 | 3614 | 0 | yes | 0 | yes |
| SYM00135 | 3615 | 3 | yes | 1 | yes |
| SYM00136 | 3616 | 1 | yes | 1 | yes |
| SYM00151 | 3617 | 1 | yes | 1 | no |
| SYM00154 | 3618 | 1 | yes | 1 | no |
| SYM00566B | 3640 | 0 | yes | 2 | yes |
| SYM00603 | 3644 | 2 | yes | 1 | yes |
| SYM00622 | 3647 | 0 | no | 0 | yes |
| SYM00629 | 3650 | 1 | yes | 2 | yes |
| SYM00663 | 3654 | 2 | yes | 0 | yes |
| SYM00696 | 3655 | 0 | no | 1 | yes |
| SYM00741a | 3657 | 0 | no | 1 | yes |
| SYM00741b | 3658 | 2 | yes | 1 | no |
| SYM00793 | 3659 | 0 | yes | 1 | no |
| SYM00577 | 3642 | 1 | yes | 1 | no |
| SYM00590 | 3643 | 2 | yes | 1 | yes |
| SYM00854 | 3661 | 2 | yes | 1 | yes |
| SYM00880 | 3662 | 3 | yes | 1 | yes |
| SYM01300 | 3672 | 1 | no | 1 | no |
| SYM01310 | 3674 | 1 | yes | 1 | yes |
| SYM01311 | 3675 | 2 | yes | 1 | no |
| SYM01314 | 3676 | 1 | no | 1 | yes |
| SYM01315 | 3677 | 3 | yes | 0 | yes |
| SYM01325 | 3678 | 0 | no | 0 | no |
| SYM01326 | 3679 | 1 | yes | 1 | yes |
| SYM01327 | 3680 | 3 | yes | 2 | yes |
| SYM01328 | 3681 | 0 | yes | 0 | yes |
| SYM01333 | 3682 | 3 | yes | 0 | yes |
| SYM15811 | 3683 | 3 | yes | 0 | yes |
| SYM15820 | 3684 | 3 | yes | 1 | no |
| SYM15821 | 3685 | 3 | yes | 1 | yes |
| SYM15825 | 3686 | 2 | yes | 2 | yes |
| SYM15828 | 3687 | 2 | yes | 1 | yes |
| SYM15831 | 3688 | 1 | yes | — | — |
| SYM15837 | 3689 | 1 | yes | 1 | yes |
| SYM15839 | 3690 | 2 | yes | 1 | yes |
| SYM15847 | 3691 | — | — | 1 | yes |
| SYM15870 | 3692 | 3 | yes | 1 | no |
| SYM15872 | 3693 | 3 | yes | 2 | yes |
| SYM15890 | 3694 | 3 | yes | 0 | no |
| SYM15901 | 3695 | 3 | yes | 1 | yes |
| SYM15920 | 3696 | 3 | yes | 1 | yes |
| SYM15926 | 3697 | 0 | yes | 1 | yes |
| SYM15928 | 3698 | 0 | yes | 2 | yes |
| SYM15932 | 3699 | 3 | yes | 1 | no |
| SYM15939 | 3700 | 3 | yes | 1 | yes |

Legend: 0 indicates <0% effect, 1 indicates <20% effect, 2 indicates <40% effect, 3 indicates >40% effect.
For Biological Effect: yes indicates >5% or <−5% effect, no indicates effect between −5% and +5%.

Of the 53 strains of seed core fungi tested in soybean bioassays, 26 (50%) had growth enhancing effects (>20% growth enhancement) on seedlings under normal conditions, while 6 (12%) had growth enhancing effects under salt conditions.

Fungi SYM00066, SYM00122, SYM00135, SYM00880, SYM01315, SYM01327, SYM01333, SYM15811, SYM15820, SYM15821, SYM15870, SYM15872, SYM15890, SYM15901, SYM15920, SYM15932, and SYM15939 all had strong effects on seedling growth of above 40% under normal conditions. 71% of these strains are able to metabolize L-arabinose and Sucrose, while 64% are able to metabolize L-Proline, D-Trehalose and D-Mannose which are compatible osmolytes produced by plants and microbes under conditions of water stress. Under conditions of salt stress, no strain improved seedling growth more than 40% relative to control, however SYM15872 and SYM01327 which had strong effects under normal conditions had moderate effects. While not able to dramatically enhance seedling growth under normal conditions, SYM15932, SYM15825, SYM00629, and SYM00566B were able to moderately enhance plant growth under conditions of salt stress (20-40%).

TABLE 38B

Assay for soy seedling growth in water agar conditions, where soy seeds were treated with combinations of core fungal endophytes.

| Strain | SEQ ID NO. | Strain | SEQ ID NO. | Normal | Biological Effect? | Salt stress | Biological Effect? |
|---|---|---|---|---|---|---|---|
| SYM15901 | 3695 | SYM00124 | 3613 | 0 | yes | 1 | yes |
| SYM15901 | 3695 | SYM15821 | 3685 | 0 | yes | 0 | no |
| SYM15901 | 3695 | SYM15870 | 3692 | 0 | yes | 1 | no |
| SYM15890 | 3694 | SYM01333 | 3682 | 0 | yes | 0 | no |
| SYM15890 | 3694 | SYM00741a | 3657 | 0 | yes | 0 | yes |
| SYM15890 | 3694 | SYM00066 | 3605 | 0 | yes | 0 | no |
| SYM15890 | 3694 | SYM15901 | 3695 | 2 | yes | 1 | no |
| SYM15890 | 3694 | SYM00124 | 3613 | 0 | yes | 0 | yes |
| SYM15890 | 3694 | SYM15821 | 3685 | 2 | yes | 0 | yes |
| SYM15890 | 3694 | SYM15870 | 3692 | 3 | yes | 1 | no |
| SYM15821 | 3685 | SYM15870 | 3692 | 3 | yes | 0 | yes |
| SYM15811 | 3683 | SYM00122 | 3611 | 0 | yes | 1 | no |
| SYM15811 | 3683 | SYM15890 | 3694 | 2 | yes | 0 | yes |
| SYM15811 | 3683 | SYM01333 | 3682 | 0 | yes | 1 | no |
| SYM15811 | 3683 | SYM00741a | 3657 | 0 | yes | 0 | no |
| SYM15811 | 3683 | SYM00066 | 3605 | 0 | yes | 1 | yes |
| SYM15811 | 3683 | SYM15901 | 3695 | 0 | yes | 0 | no |
| SYM15811 | 3683 | SYM00124 | 3613 | 0 | yes | 0 | yes |
| SYM15811 | 3683 | SYM15821 | 3685 | 0 | yes | 1 | yes |
| SYM15811 | 3683 | SYM15870 | 3692 | 1 | yes | 1 | no |
| SYM01333 | 3682 | SYM00741a | 3657 | 0 | yes | 0 | yes |
| SYM01333 | 3682 | SYM00066 | 3605 | 0 | yes | 1 | no |
| SYM01333 | 3682 | SYM15901 | 3695 | 0 | no | 1 | yes |
| SYM01333 | 3682 | SYM00124 | 3613 | 0 | yes | 0 | yes |
| SYM01333 | 3682 | SYM15821 | 3685 | 0 | no | 1 | yes |
| SYM01333 | 3682 | SYM15870 | 3692 | 0 | yes | 1 | yes |
| SYM00135 | 3615 | SYM15811 | 3683 | 0 | yes | 1 | no |
| SYM00135 | 3615 | SYM00122 | 3611 | 0 | yes | 1 | yes |
| SYM00135 | 3615 | SYM15890 | 3694 | 1 | yes | 1 | yes |
| SYM00135 | 3615 | SYM01333 | 3682 | 0 | yes | 1 | no |
| SYM00135 | 3615 | SYM00741a | 3657 | 0 | yes | 0 | no |
| SYM00135 | 3615 | SYM00066 | 3605 | 0 | yes | 1 | no |
| SYM00135 | 3615 | SYM15901 | 3695 | 0 | yes | 1 | yes |
| SYM00135 | 3615 | SYM00124 | 3613 | 0 | yes | 0 | no |
| SYM00135 | 3615 | SYM15821 | 3685 | 0 | yes | 1 | yes |

Legend: 0 indicates <0% effect, 1 indicates <20% effect, 2 indicates <40% effect, 3 indicates >40% effect.
For Biological Effect: yes indicates >5% or <−5% effect, no indicates effect between −5% and +5%.

Under normal conditions 5 out of 51 strains (10% of total) conferred beneficial effect with greater than 20% of growth enhancement including two combinations (SYM15890+SYM15870 and SYM15821+SYM15870) that had greater than 40% enhancement in growth. Under salt stress 11 out of 51 strains (22% of total) showed significance enhancement (higher than 5%) in growth compared to formulation.

TABLE 39A

Assay for wheat seedling growth in water agar conditions, where wheat seeds were treated with core bacterial endophytes.

| Strain | SEQ ID NO. | Normal | Biological Effect? | Salt stress | Biological Effect? |
|---|---|---|---|---|---|
| SYM00003 | 3588 | 1 | yes | 0 | yes |
| SYM00009 | 3589 | 1 | yes | 0 | yes |
| SYM00013 | 3590 | 1 | yes | 0 | yes |
| SYM00017A | 3591 | 1 | yes | 0 | yes |
| SYM00018 | 3592 | 1 | yes | 0 | yes |
| SYM00020 | 3593 | 2 | yes | 0 | yes |
| SYM00050 | 3600 | 2 | yes | 0 | yes |
| SYM00053 | 3601 | 1 | yes | 0 | yes |
| SYM00062C | 3603 | 2 | yes | 1 | yes |
| SYM00068 | 3606 | 2 | yes | 0 | yes |
| SYM00070 | 3607 | 0 | no | 0 | yes |
| SYM00103 | 3609 | 2 | yes | 0 | yes |
| SYM00183 | 3620 | 2 | yes | 0 | yes |
| SYM00184 | 3621 | 2 | yes | 2 | yes |
| SYM00207 | 3622 | 1 | yes | 0 | yes |
| SYM00212 | 3623 | 2 | yes | 0 | yes |
| SYM00219 | 3624 | 0 | no | 0 | yes |
| SYM00234 | 3625 | 1 | yes | 0 | no |
| SYM00236 | 3626 | 1 | yes | 2 | yes |
| SYM00248 | 3627 | 1 | yes | 2 | yes |
| SYM00249 | 3628 | 2 | yes | 3 | yes |
| SYM00506c | 3629 | 1 | yes | 3 | yes |
| SYM00507 | 3630 | 1 | yes | 0 | yes |
| SYM00508 | 3631 | 2 | yes | 0 | yes |
| SYM00525 | 3632 | 2 | yes | 0 | yes |
| SYM00538A | 3633 | 1 | yes | 0 | yes |
| SYM00538B | 3634 | 2 | yes | 0 | yes |
| SYM00538i | 3635 | 1 | yes | 0 | yes |
| SYM00543 | 3636 | 1 | yes | 0 | yes |
| SYM00563 | 3639 | 2 | yes | 0 | yes |
| SYM00574 | 3641 | 1 | yes | 0 | yes |
| SYM00617 | 3645 | 1 | yes | 3 | yes |
| SYM00620 | 3646 | 2 | yes | 0 | yes |
| SYM00627 | 3648 | 2 | yes | 0 | no |
| SYM00628 | 3649 | 3 | yes | 2 | yes |
| SYM00650 | 3652 | 1 | yes | 2 | yes |
| SYM00714 | 3656 | 1 | yes | 3 | yes |
| SYM00905 | 3663 | 1 | yes | 3 | yes |
| SYM00924 | 3664 | 1 | no | 0 | yes |
| SYM00963 | 3665 | 2 | yes | 0 | yes |
| SYM00978 | 3668 | 1 | yes | 2 | yes |

TABLE 39A-continued

Assay for wheat seedling growth in water agar conditions, where wheat seeds were treated with core bacterial endophytes.

| Strain | SEQ ID NO. | Normal | Biological Effect? | Salt stress | Biological Effect? |
|---|---|---|---|---|---|
| SYM00982 | 3666 | 1 | yes | 0 | yes |
| SYM00987 | 3667 | 1 | yes | 3 | yes |
| SYM00991 | 3669 | 1 | no | 0 | yes |

TABLE 39A-continued

Assay for wheat seedling growth in water agar conditions, where wheat seeds were treated with core bacterial endophytes.

| Strain | SEQ ID NO. | Normal | Biological Effect? | Salt stress | Biological Effect? |
|---|---|---|---|---|---|
| SYM00999 | 3670 | 1 | yes | 0 | yes |
| SYM01049 | 3671 | 1 | yes | 0 | yes |

Legend: 0 indicates <0% effect, 1 indicates <20% effect, 2 indicates <40% effect, 3 indicates >40% effect.
For Biological Effect: yes indicates >5% or <−5% effect, no indicates effect between −5% and +5%.

In general, bacterial endophyte-coated wheat seedlings performed well compared to formulation control under normal conditions, i.e., water agar. 17 out 47 strains tested (36% of total) exhibited move than 20% of the enhancement in growth and conferred a significantly noticeable beneficial effect to wheat seedlings. Under the saline stress condition (water agar supplemented with 100 mM NaCl), 12 out of 44 strains tested (25% of total) exhibited more than 20% of the enhancement in growth, while 6 out of the 47 strains (12% of total) exhibited greater than 40% of the enhancement in growth. Particularly, 3 strains, SYM00184, SYM00249, and SYM00628 conferred a beneficial effect to wheat seedlings in both normal and saline stress conditions.

TABLE 39B

Assay for wheat seedling growth in water agar conditions, where wheat seeds were treated with combinations of core bacterial endophytes.

| Strain 1 | SEQ ID NO. | Strain 2 | SEQ ID NO. | Normal | Biological Effect? | Salt stress | Biological Effect? |
|---|---|---|---|---|---|---|---|
| SYM00050 | 3600 | SYM00053 | 3601 | 0 | yes | 0 | yes |
| SYM00050 | 3600 | SYM00207 | 3622 | 2 | yes | 0 | yes |
| SYM00050 | 3600 | SYM00248 | 3627 | 0 | no | 0 | yes |
| SYM00050 | 3600 | SYM00508 | 3631 | 3 | yes | 0 | yes |
| SYM00050 | 3600 | SYM00574 | 3641 | 3 | yes | 2 | yes |
| SYM00050 | 3600 | SYM00978 | 3668 | 1 | yes | 0 | yes |
| SYM00050 | 3600 | SYM00991 | 3669 | 3 | yes | 0 | yes |
| SYM00053 | 3601 | SYM00207 | 3622 | 0 | no | 0 | yes |
| SYM00053 | 3601 | SYM00248 | 3627 | 2 | yes | 0 | yes |
| SYM00053 | 3601 | SYM00508 | 3631 | 3 | yes | 0 | yes |
| SYM00053 | 3601 | SYM00574 | 3641 | 0 | yes | 0 | yes |
| SYM00053 | 3601 | SYM00628 | 3649 | 2 | yes | 0 | yes |
| SYM00053 | 3601 | SYM00978 | 3668 | 1 | yes | 0 | yes |
| SYM00053 | 3601 | SYM00991 | 3669 | 1 | yes | 0 | yes |
| SYM00053 | 3601 | SYM01049 | 3671 | 1 | yes | 2 | yes |
| SYM00207 | 3622 | SYM00248 | 3627 | 1 | yes | 0 | yes |
| SYM00207 | 3622 | SYM00508 | 3631 | 0 | yes | 0 | yes |
| SYM00207 | 3622 | SYM00574 | 3641 | 2 | yes | 0 | yes |
| SYM00207 | 3622 | SYM00628 | 3649 | 3 | yes | 0 | yes |
| SYM00207 | 3622 | SYM00978 | 3668 | 0 | no | 0 | yes |
| SYM00207 | 3622 | SYM00991 | 3669 | 1 | yes | 0 | yes |
| SYM00207 | 3622 | SYM01049 | 3671 | 1 | yes | 0 | yes |
| SYM00248 | 3627 | SYM00574 | 3641 | 2 | yes | 0 | yes |
| SYM00248 | 3627 | SYM00628 | 3649 | 2 | yes | 0 | yes |
| SYM00248 | 3627 | SYM00991 | 3669 | 0 | no | 0 | yes |
| SYM00248 | 3627 | SYM01049 | 3671 | 0 | yes | 0 | yes |
| SYM00508 | 3631 | SYM00574 | 3641 | 1 | yes | 0 | yes |
| SYM00508 | 3631 | SYM00628 | 3649 | 3 | yes | 1 | yes |
| SYM00508 | 3631 | SYM00991 | 3669 | 3 | yes | 0 | yes |
| SYM00508 | 3631 | SYM01049 | 3671 | 1 | no | 0 | yes |
| SYM00574 | 3641 | SYM00628 | 3649 | 2 | yes | 0 | yes |
| SYM00574 | 3641 | SYM00978 | 3668 | 0 | no | 0 | yes |
| SYM00574 | 3641 | SYM00991 | 3669 | 0 | yes | 0 | yes |
| SYM00574 | 3641 | SYM01049 | 3671 | 2 | yes | 0 | yes |
| SYM00628 | 3649 | SYM00978 | 3668 | 0 | yes | 0 | yes |
| SYM00628 | 3649 | SYM00991 | 3669 | 0 | yes | 0 | yes |
| SYM00991 | 3669 | SYM00978 | 3668 | 1 | yes | 0 | yes |
| SYM00991 | 3669 | SYM01049 | 3671 | 0 | yes | 0 | yes |
| SYM01049 | 3671 | SYM00978 | 3668 | 3 | yes | 0 | yes |

Legend: 0 indicates <0% effect, 1 indicates <20% effect, 2 indicates <40% effect, 3 indicates >40% effect.
For Biological Effect: yes indicates >5% or <−5% effect, no indicates effect between −5% and +5%.

Under normal condition (water agar), 16 out of 39 (41% of total) combinations of bacterial endophytes conferred a noticeable beneficial effect with a greater than 20% of growth enhancement. Similarly, under saline stress condition (water agar supplemented with 100 mM NaCl), 2 out of 39 (5% of total) combinations tested conferred a noticeable beneficial effect with a greater than 20% of growth enhancement. Collectively, there are 3 combinations that conferred an effect in all experimental conditions. Among the 6 strains in these combinations (3 combinations×2), SYM00050, SYM00053, SYM00508, SYM00574, SYM0628 and SYM01049 conferred a beneficial effect to wheat seedlings in both normal and saline stress conditions.

TABLE 40A

Assay for wheat seedling growth in water agar conditions, where wheat seeds were treated with core fungal endophytes.

| Strain | SEQ ID NO. | Normal | Salt stress |
|---|---|---|---|
| SYM00034 | 3597 | 2 | 0 |
| SYM00061A | 3602 | 2 | 0 |
| SYM00066 | 3605 | 2 | 0 |
| SYM00120 | 3610 | 2 | 0 |
| SYM00122 | 3611 | 3 | 0 |
| SYM00123 | 3612 | 1 | 0 |
| SYM00124 | 3613 | 3 | 0 |
| SYM00129 | 3614 | 3 | 0 |
| SYM00135 | 3615 | 2 | 0 |
| SYM00136 | 3616 | 3 | 0 |
| SYM00151 | 3617 | 3 | 0 |
| SYM00154 | 3618 | 3 | 0 |
| SYM00566B | 3640 | 2 | 0 |
| SYM00577 | 3642 | 2 | 0 |
| SYM00590 | 3643 | 3 | 0 |
| SYM00603 | 3644 | 3 | 0 |
| SYM00622 | 3647 | 3 | 0 |
| SYM00629 | 3650 | 2 | 0 |
| SYM00663 | 3654 | 3 | — |
| SYM00696 | 3655 | 2 | 0 |
| SYM00741a | 3657 | 3 | 0 |
| SYM00741b | 3658 | 3 | 0 |
| SYM00793 | 3659 | 0 | 0 |
| SYM00854 | 3661 | 2 | 0 |
| SYM00880 | 3662 | 2 | 0 |
| SYM01300 | 3672 | 2 | 0 |
| SYM01310 | 3674 | 2 | 0 |
| SYM01311 | 3675 | 2 | 0 |
| SYM01314 | 3676 | 3 | 0 |
| SYM01315 | 3677 | 3 | 0 |
| SYM01325 | 3678 | 2 | 0 |
| SYM01326 | 3679 | 2 | 0 |
| SYM01327 | 3680 | 3 | 0 |
| SYM01328 | 3681 | 3 | 0 |
| SYM01333 | 3682 | 3 | 0 |
| SYM15811 | 3683 | 2 | 0 |
| SYM15820 | 3684 | 2 | 0 |
| SYM15821 | 3685 | 3 | 0 |
| SYM15825 | 3686 | 2 | 0 |
| SYM15828 | 3687 | 2 | 0 |
| SYM15831 | 3688 | 2 | 0 |
| SYM15837 | 3689 | 0 | 0 |
| SYM15839 | 3690 | 3 | 0 |
| SYM15847 | 3691 | 3 | 0 |
| SYM15870 | 3692 | 3 | 0 |
| SYM15872 | 3693 | 3 | 0 |
| SYM15890 | 3694 | 3 | 0 |
| SYM15901 | 3695 | 3 | 0 |
| SYM15920 | 3696 | 3 | 0 |
| SYM15926 | 3697 | 3 | 0 |
| SYM15928 | 3698 | 2 | 0 |
| SYM15932 | 3699 | 2 | 0 |
| SYM15939 | 3700 | 1 | 0 |

Legend: 0 indicates <0% effect, 1 indicates <20% effect, 2 indicates <40% effect, 3 indicates >40% effect.
For Biological Effect: yes indicates >5% or <−5% effect, no indicates effect between −5% and +5%.

Under the normal condition (water agar), out of the 53 fungal endophytes tested, 26 (~50% of total) conferred a beneficial effect to wheat with greater than 50% of growth enhancement. These include 7 *Fusarium* spp., 4 *Acremonium* spp., 4 *Alternaria* spp., and 4 *Cladosporium*. Interestingly, these 4 groups of fungi are also top hits in auxin and indolic compound production, acetoin accumulation, and siderophore accumulation (Example 5, Table 36B). This suggests a correlation of between the accumulation of auxin, indolic compound, acetoin, and siderophore and the beneficial effect. Surprisingly, we were unable to identify any fungal strains that confer a beneficial effect to wheat in saline stress condition (water agar supplemented with 100 mM NaCl).

TABLE 40B

Assay for wheat seedling growth in water agar conditions, where wheat seeds were treated with combinations of core fungal endophytes.

| Strain 1 | SEQ ID NO. | Strain 2 | SEQ ID NO. | Normal* | Salt stress |
|---|---|---|---|---|---|
| SYM15901 | 3695 | SYM00124 | 3613 | 0 | − |
| SYM15901 | 3695 | SYM15821 | 3685 | N/A | − |
| SYM15890 | 3694 | SYM01333 | 3682 | + | N/A |
| SYM15890 | 3694 | SYM00741a | 3657 | N/A | 0 |
| SYM15890 | 3694 | SYM01315 | 3677 | 0 | 0 |
| SYM15890 | 3694 | SYM15901 | 3695 | 0 | − |
| SYM15890 | 3694 | SYM00124 | 3613 | N/A | − |
| SYM15890 | 3694 | SYM15870 | 3692 | 0 | 0 |
| SYM15821 | 3685 | SYM15870 | 3692 | N/A | − |
| SYM15811 | 3683 | SYM00122 | 3611 | −/−c | + |
| SYM15811 | 3683 | SYM15890 | 3694 | − | + |
| SYM15811 | 3683 | SYM00741a | 3657 | N/A | 0 |
| SYM15811 | 3683 | SYM01315 | 3677 | − | − |
| SYM15811 | 3683 | SYM00066 | 3605 | 0/−c | 0 |
| SYM15811 | 3683 | SYM15901 | 3695 | +/c | − |
| SYM15811 | 3683 | SYM15821 | 3685 | +/c | + |
| SYM15811 | 3683 | SYM15870 | 3692 | 0 | + |
| SYM01315 | 3677 | SYM00066 | 3605 | −/−c | N/A |
| SYM01315 | 3677 | SYM15901 | 3695 | N/A | 0 |
| SYM01315 | 3677 | SYM15821 | 3685 | −/−c | N/A |
| SYM01315 | 3677 | SYM15870 | 3692 | −/−c | 0 |
| SYM01333 | 3682 | SYM00741a | 3657 | −/−d | 0 |
| SYM01333 | 3682 | SYM01315 | 3677 | −/−c | N/A |
| SYM01333 | 3682 | SYM15901 | 3695 | 0/−d | − |
| SYM01333 | 3682 | SYM00124 | 3613 | −/−c, −d | N/A |
| SYM01333 | 3682 | SYM15821 | 3685 | −/−d | + |
| SYM01333 | 3682 | SYM15870 | 3692 | N/A | 0 |
| SYM00741a | 3657 | SYM00066 | 3605 | −/−c | 0 |
| SYM00741a | 3657 | SYM15901 | 3695 | −/−c, −d | − |
| SYM00741a | 3657 | SYM00124 | 3613 | N/A | − |
| SYM00741a | 3657 | SYM15821 | 3685 | −/−c | 0 |
| SYM00741a | 3657 | SYM15870 | 3692 | −/−c, −d | N/A |
| SYM00135 | 3615 | SYM15811 | 3683 | +/d | 0 |
| SYM00135 | 3615 | SYM00122 | 3611 | −/−e | 0 |
| SYM00135 | 3615 | SYM15890 | 3694 | −/d | N/A |
| SYM00135 | 3615 | SYM01333 | 3682 | −/−c, −d | N/A |
| SYM00135 | 3615 | SYM00741a | 3657 | 0/−c | N/A |
| SYM00135 | 3615 | SYM01315 | 3677 | 0 | + |
| SYM00135 | 3615 | SYM00124 | 3613 | − | − |
| SYM00135 | 3615 | SYM15821 | 3685 | −/c, d | + |

*Any symbol to the left of the "/" pertains to primary radicle length with +, 0, − denoting an increase, no change, or decrease relative to control seedling radicles, respectively.
The scale (a-e) to the right of the "/" pertains to relative increases or decreases in secondary characteristics of the seedlings as follows: a) root hair development, b) lateral root number, c) lateral root size, d) shoot length, and e) root thickness.

Under normal condition (water agar), four combinations of core fungi endophytes conferred a noticeable beneficial effect with longer root growth relative to formulation only treated seeds. Under saline stress condition (water agar supplemented with 100 mM NaCl), seven combinations that were tested conferred noticeable beneficial effect with a greater root length in comparison with formulation only treated wheat seeds.

Filter Paper Growth Assay

Wheat seeds were sterilized and coated with the appropriate endophyte as described in Example 7. They were then placed in filter paper growth assays as described in Example 5. After 5-8 days of growth, a picture of each plate was taken and analyzed as described in Example 5.

The effects of bacterial and fungal endophytes belonging to core OTUs on the growth of wheat seeds in a filter paper assay is shown in Tables 41A and B and 42A and B.

TABLE 41A

Growth of wheat seeds treated with bacterial endophytes belonging to OTUs present in corn, wheat, cotton and soy seeds.

| Strain | SEQ ID NO. | Normal | Biological Effect? | Water stress | Biological Effect? |
|---|---|---|---|---|---|
| SYM00003 | 3588 | 1 | yes | — | — |
| SYM00009 | 3589 | 1 | no | 1 | yes |
| SYM00013 | 3590 | 1 | yes | 1 | yes |
| SYM00017A | 3591 | 0 | no | 1 | yes |
| SYM00018 | 3592 | 0 | yes | 1 | no |
| SYM00020 | 3593 | 1 | yes | 1 | no |
| SYM00050 | 3600 | 0 | no | 0 | no |
| SYM00053 | 3601 | 1 | yes | 1 | yes |
| SYM00062C | 3603 | 0 | yes | 2 | yes |
| SYM00068 | 3606 | 2 | yes | 0 | no |
| SYM00070 | 3607 | 1 | yes | 1 | yes |
| SYM00103 | 3609 | 0 | no | 1 | yes |
| SYM00183 | 3620 | 1 | no | 1 | yes |
| SYM00184 | 3621 | 1 | yes | 0 | no |
| SYM00207 | 3622 | 0 | no | 1 | no |
| SYM00212 | 3623 | 0 | yes | 2 | yes |
| SYM00219 | 3624 | 0 | no | 0 | yes |
| SYM00234 | 3625 | 1 | yes | 1 | yes |
| SYM00236 | 3626 | 1 | yes | 1 | yes |
| SYM00248 | 3627 | 2 | yes | 1 | yes |
| SYM00249 | 3628 | 2 | yes | 0 | no |
| SYM00506c | 3629 | 2 | yes | 1 | yes |
| SYM00507 | 3630 | 1 | yes | 0 | yes |
| SYM00508 | 3631 | 2 | yes | 1 | yes |
| SYM00525 | 3632 | 1 | yes | 1 | yes |
| SYM00538A | 3633 | 2 | yes | 0 | no |
| SYM00538B | 3634 | 0 | no | 2 | yes |
| SYM00538i | 3635 | 0 | yes | 2 | yes |
| SYM00543 | 3636 | 1 | yes | 0 | yes |
| SYM00563 | 3639 | 1 | yes | 1 | no |
| SYM00574 | 3641 | 0 | yes | 0 | no |
| SYM00617 | 3645 | 2 | yes | 0 | yes |
| SYM00620 | 3646 | 2 | yes | 1 | yes |
| SYM00627 | 3648 | 2 | yes | 0 | yes |
| SYM00628 | 3649 | 1 | yes | 2 | yes |
| SYM00650 | 3652 | 1 | yes | 0 | yes |
| SYM00714 | 3656 | 0 | yes | 1 | yes |
| SYM00905 | 3663 | 2 | yes | 3 | yes |
| SYM00924 | 3664 | 2 | yes | 0 | yes |
| SYM00963 | 3665 | 1 | yes | 0 | no |
| SYM00978 | 3668 | 3 | yes | 0 | no |
| SYM00982 | 3666 | 0 | yes | 0 | yes |
| SYM00987 | 3667 | 1 | yes | 0 | no |
| SYM00991 | 3669 | 1 | no | 1 | yes |
| SYM00999 | 3670 | 1 | yes | 1 | yes |
| SYM01049 | 3671 | 0 | no | 1 | yes |

Legend: 0 indicates <0% effect, 1 indicates <20% effect, 2 indicates <40% effect, 3 indicates >40% effect.
For Biological Effect: yes indicates >5% or <−5% effect, no indicates effect between −5% and +5%.

Under the normal condition (filter paper soaked with sterile water), 12 out of 32 tested strains (38% of total) conferred beneficial effect to wheat with greater than 20% of growth enhancement, whereas 6 out of 43 strains (14% of total) tested showed beneficial effect under water stress condition (filter paper soaked with 8% PEG 6000). The bacterial endophytes treated on wheat seeds and tested in filter paper assays that produced beneficial effects belong to a great diversity of genera: *Pseudomonas, Curtobacterium, Paenibacillus, Bacillus, Enterobacter, Agrobacterium, Chrysobacterium, Escherichia* and *Methylobacterium*. We have not observed over-representation of certain taxonomic groups of bacteria. All of these bacteria produced intermediate to high levels of auxin, acetoin and siderophore production (Example 5, Table 34A) and are able to metabolize intermediate to large numbers of substrates (Table 31B). The exceptions to this were SYM00982 that had low levels of siderophore production and only metabolized 3 substrates and SYM00999 that had low levels of both siderophore and auxin production and metabolized 6 substrates.

TABLE 41B

Growth of wheat seeds treated with combinations of bacterial endophytes, belonging to OTUs present in corn, wheat, cotton and soy seeds.

| Strain 1 | SEQ ID NO. | Strain 2 | SEQ ID NO. | Normal | Biological effect? | Water stress | Biological effect? |
|---|---|---|---|---|---|---|---|
| SYM00053 | 3601 | SYM01049 | 3671 | 1 | No | 0 | Yes |
| SYM00207 | 3622 | SYM00248 | 3627 | 2 | Yes | 0 | Yes |
| SYM00207 | 3622 | SYM00508 | 3631 | 2 | Yes | 0 | Yes |
| SYM00207 | 3622 | SYM00574 | 3641 | 1 | Yes | 0 | Yes |
| SYM00207 | 3622 | SYM00628 | 3649 | 1 | Yes | 1 | Yes |
| SYM00207 | 3622 | SYM00978 | 3668 | 1 | yes | 0 | Yes |
| SYM00207 | 3622 | SYM00991 | 3669 | 1 | Yes | 0 | Yes |
| SYM00207 | 3622 | SYM01049 | 3671 | 2 | Yes | 1 | No |
| SYM00248 | 3627 | SYM00574 | 3641 | 0 | Yes | 0 | Yes |
| SYM00248 | 3627 | SYM00628 | 3649 | 2 | Yes | 0 | Yes |
| SYM00248 | 3627 | SYM00991 | 3669 | 2 | Yes | 1 | No |
| SYM00248 | 3627 | SYM01049 | 3671 | 2 | Yes | 0 | Yes |
| SYM00508 | 3631 | SYM00574 | 3641 | 2 | Yes | 0 | Yes |
| SYM00508 | 3631 | SYM00628 | 3649 | 0 | Yes | 0 | Yes |
| SYM00508 | 3631 | SYM00991 | 3669 | 0 | Yes | 0 | Yes |
| SYM00508 | 3631 | SYM01049 | 3671 | 1 | No | 0 | Yes |
| SYM00574 | 3641 | SYM00628 | 3649 | 1 | Yes | 0 | Yes |
| SYM00574 | 3641 | SYM00978 | 3668 | 1 | Yes | 0 | Yes |
| SYM00574 | 3641 | SYM00991 | 3669 | 0 | No | 0 | Yes |
| SYM00574 | 3641 | SYM01049 | 3671 | 1 | yes | 0 | Yes |
| SYM00628 | 3649 | SYM00978 | 3668 | 1 | Yes | 0 | Yes |
| SYM00628 | 3649 | SYM00991 | 3669 | 3 | Yes | 0 | Yes |
| SYM00991 | 3669 | SYM00978 | 3668 | 1 | Yes | 0 | Yes |

TABLE 41B-continued

Growth of wheat seeds treated with combinations of bacterial endophytes, belonging to OTUs present in corn, wheat, cotton and soy seeds.

| Strain 1 | SEQ ID NO. | Strain 2 | SEQ ID NO. | Normal | Biological effect? | Water stress | Biological effect? |
|---|---|---|---|---|---|---|---|
| SYM00991 | 3669 | SYM01049 | 3671 | 1 | Yes | 0 | Yes |
| SYM01049 | 3671 | SYM00978 | 3668 | 1 | No | 0 | Yes |

0 indicates <0% effect, 1 indicates <20% effect, 2 indicates <40% effect, 3 indicates >40% effect.
For Biological Effect: yes indicates >5% or <−5% effect, no indicates effect between −5% and +5%.

A variety of binary combinations of bacterial endophytes conferred a benefit under non-stress and/or water stress conditions. SYM00207, for instance, is present in several combinations that provide a benefit under normal conditions, including in tandem with SYM00574 or SYM01049. None of these strains alone confer a benefit to normal condition plants. SYM00628 provides an observable benefit under both normal and water-limited conditions. The benefit under normal conditions is increased when SYM00628 is combined with SYM00991, which itself also provides a relatively lower benefit under the normal condition. SYM00628 belongs to the genus Enterobacter, while SYM00991 belongs to the genus Acidovorax.

TABLE 42A

Growth of wheat seeds treated with fungal endophytes belonging to OTUs present in corn, wheat, and cotton seeds

| Strain | SEQ ID NO. | Normal | Water stress |
|---|---|---|---|
| SYM00034 | 3597 | 1 | 0 |
| SYM00061A | 3602 | 1 | 0 |
| SYM00066 | 3605 | 2 | 0 |
| SYM00120 | 3610 | 1 | 1 |
| SYM00122 | 3611 | 0 | 0 |
| SYM00123 | 3612 | 0 | 0 |
| SYM00124 | 3613 | 2 | 0 |
| SYM00129 | 3614 | 0 | 0 |
| SYM00135 | 3615 | 2 | 1 |
| SYM00136 | 3616 | 2 | 0 |
| SYM00151 | 3617 | 2 | 2 |
| SYM00154 | 3618 | 2 | 2 |
| SYM00566B | 3640 | 1 | 0 |
| SYM00603 | 3644 | 1 | 0 |
| SYM00622 | 3647 | 2 | 3 |
| SYM00629 | 3650 | 0 | 0 |
| SYM00663 | 3654 | 0 | 0 |
| SYM00696 | 3655 | 0 | 0 |
| SYM00741a | 3657 | 1 | 0 |
| SYM00741b | 3658 | 0 | 0 |
| SYM00793 | 3659 | 1 | 0 |
| SYM00577 | 3642 | 1 | 0 |
| SYM00590 | 3643 | 1 | 0 |
| SYM00854 | 3661 | 2 | 0 |
| SYM00880 | 3662 | 2 | 0 |
| SYM01300 | 3672 | 0 | 0 |
| SYM01310 | 3674 | 1 | 0 |
| SYM01311 | 3675 | 0 | 0 |
| SYM01314 | 3676 | 2 | 0 |
| SYM01315 | 3677 | 1 | 0 |
| SYM01325 | 3678 | 2 | 0 |
| SYM01326 | 3679 | 2 | 1 |
| SYM01327 | 3680 | 2 | 2 |
| SYM01328 | 3681 | 2 | 0 |
| SYM01333 | 3682 | 1 | 0 |
| SYM15811 | 3683 | 0 | 2 |
| SYM15820 | 3684 | 2 | 2 |
| SYM15821 | 3685 | 2 | 0 |
| SYM15825 | 3686 | 2 | 1 |
| SYM15828 | 3687 | 2 | 0 |
| SYM15831 | 3688 | 2 | 0 |
| SYM15837 | 3689 | 0 | 0 |
| SYM15839 | 3690 | 2 | 0 |
| SYM15847 | 3691 | 2 | 0 |
| SYM15870 | 3692 | 2 | 0 |
| SYM15872 | 3693 | 2 | 0 |
| SYM15890 | 3694 | 3 | 0 |
| SYM15901 | 3695 | 2 | 2 |
| SYM15920 | 3696 | 2 | 0 |
| SYM15926 | 3697 | 2 | 2 |
| SYM15928 | 3698 | 0 | 0 |
| SYM15932 | 3699 | 2 | 0 |
| SYM15939 | 3700 | 1 | 0 |

Under the normal condition (filter paper with sterile water), out of the 53 fungal endophytes tested, 34 (~61% of total) conferred a beneficial effect to wheat with greater than 20% of growth enhancement. Several taxonomic groups of fungi, including Fusarium, Acremonium, Alternaria, and Cladosporium, are over-represented. Interestingly, these 4 groups of fungi are also top hits in auxin and indolic compound production, acetoin accumulation, and siderophore accumulation (Example 5, Table 36B). This suggests a correlation of between the accumulation of auxin, indolic compound, acetoin, and siderophore and the beneficial effect. Under the water stress condition (filter paper with 8% PEG 6000), 8 out of 53 strains tested (15% of total) conferred a beneficial effect to wheat with greater than 20% of growth enhancement. Similarly, the top hits belong to the genera of Fusarium, Alternaria, Acremonium, and Cladosporium. However, not over-representation of these taxonomic groups has been observed. Of all strains tested, 9 strains, including 3 Alternaria spp. and 2 Fusarium spp., conferred a beneficial effect to wheat in both normal and water stress conditions.

TABLE 42B

Growth of wheat seeds treated with combinations of fungal endophytes belonging to OTUs present in corn, wheat, and cotton seeds.

| Strain 1 | SEQ ID NO. | Strain 2 | SEQ ID NO. | Normal | Biological effect? | Water stress | Biological effect? |
|---|---|---|---|---|---|---|---|
| SYM15901 | 3695 | SYM00124 | 3613 | 1 | No | 0 | yes |
| SYM15901 | 3695 | SYM15821 | 3685 | 0 | Yes | 0 | No |
| SYM15901 | 3695 | SYM15870 | 3692 | 2 | Yes | 1 | Yes |
| SYM15890 | 3694 | SYM01333 | 3682 | 1 | Yes | 1 | Yes |
| SYM15890 | 3694 | SYM00741a | 3657 | 1 | Yes | 0 | No |
| SYM15890 | 3694 | SYM01315 | 3677 | 1 | Yes | 1 | no |
| SYM15890 | 3694 | SYM00066 | 3605 | 1 | Yes | 0 | Yes |
| SYM15890 | 3694 | SYM15901 | 3695 | 1 | Yes | 2 | Yes |
| SYM15890 | 3694 | SYM00124 | 3613 | 0 | No | 2 | Yes |
| SYM15890 | 3694 | SYM15821 | 3685 | 1 | Yes | 0 | Yes |
| SYM15890 | 3694 | SYM15870 | 3692 | 0 | Yes | 0 | Yes |
| SYM15821 | 3685 | SYM15870 | 3692 | 2 | yes | 0 | Yes |
| SYM15811 | 3683 | SYM00122 | 3611 | 1 | Yes | 0 | Yes |
| SYM15811 | 3683 | SYM15890 | 3694 | 1 | Yes | 0 | No |
| SYM15811 | 3683 | SYM01333 | 3682 | 2 | Yes | 1 | No |
| SYM15811 | 3683 | SYM00741a | 3657 | 1 | Yes | 1 | No |
| SYM15811 | 3683 | SYM01315 | 3677 | 1 | Yes | 0 | yes |
| SYM15811 | 3683 | SYM00066 | 3605 | 1 | Yes | 0 | No |
| SYM15811 | 3683 | SYM15901 | 3695 | 1 | No | 0 | No |
| SYM15811 | 3683 | SYM00124 | 3613 | 0 | No | 1 | No |
| SYM15811 | 3683 | SYM15821 | 3685 | 1 | Yes | 1 | Yes |
| SYM15811 | 3683 | SYM15870 | 3692 | 1 | No | 1 | Yes |
| SYM01315 | 3677 | SYM00066 | 3605 | 2 | Yes | 1 | Yes |
| SYM01315 | 3677 | SYM15901 | 3695 | 2 | Yes | 2 | Yes |
| SYM01315 | 3677 | SYM00124 | 3613 | 1 | Yes | 0 | yes |
| SYM01315 | 3677 | SYM15821 | 3685 | 2 | Yes | 2 | yes |
| SYM01315 | 3677 | SYM15870 | 3692 | 0 | No | 1 | No |
| SYM01333 | 3682 | SYM00741a | 3657 | 1 | No | 0 | Yes |
| SYM01333 | 3682 | SYM01315 | 3677 | 1 | Yes | 0 | yes |
| SYM01333 | 3682 | SYM00066 | 3605 | 0 | Yes | 1 | Yes |
| SYM01333 | 3682 | SYM15901 | 3695 | 0 | Yes | 1 | Yes |
| SYM01333 | 3682 | SYM00124 | 3613 | 1 | Yes | 0 | Yes |
| SYM01333 | 3682 | SYM15821 | 3685 | 0 | Yes | 0 | Yes |
| SYM01333 | 3682 | SYM15870 | 3692 | 1 | No | 0 | Yes |
| SYM00741a | 3657 | SYM01315 | 3677 | 0 | No | 1 | no |
| SYM00741a | 3657 | SYM00066 | 3605 | 1 | Yes | 0 | No |
| SYM00741a | 3657 | SYM15901 | 3695 | 1 | Yes | 2 | Yes |
| SYM00741a | 3657 | SYM00124 | 3613 | 0 | No | 0 | Yes |
| SYM00741a | 3657 | SYM15821 | 3685 | 1 | No | 2 | Yes |
| SYM00741a | 3657 | SYM15870 | 3692 | 2 | Yes | 1 | Yes |
| SYM00135 | 3615 | SYM15811 | 3683 | 1 | Yes | 0 | No |
| SYM00135 | 3615 | SYM00122 | 3611 | 1 | Yes | 0 | Yes |
| SYM00135 | 3615 | SYM15890 | 3694 | 1 | Yes | 2 | Yes |
| SYM00135 | 3615 | SYM01333 | 3682 | 1 | Yes | 0 | Yes |
| SYM00135 | 3615 | SYM00741a | 3657 | 2 | Yes | 0 | Yes |
| SYM00135 | 3615 | SYM01315 | 3677 | 1 | Yes | 0 | yes |
| SYM00135 | 3615 | SYM00066 | 3605 | 2 | Yes | 1 | No |
| SYM00135 | 3615 | SYM15901 | 3695 | 1 | Yes | 1 | Yes |
| SYM00135 | 3615 | SYM00124 | 3613 | 2 | Yes | 0 | No |
| SYM00135 | 3615 | SYM15821 | 3685 | 0 | No | 1 | Yes |

Legend: 0 indicates <0% effect, 1 indicates <20% effect, 2 indicates <40% effect, 3 indicates >40% effect.
For Biological Effect: yes indicates >5% or <−5% effect, no indicates effect between −5% and +5%.

Several core combinations of fungal SYM strains showed beneficial effects on wheat both under normal and water stress conditions. The combinatory effect of these beneficial strains was indicative of overall synergistic underlying mechanisms that drive beneficial effect on the seedlings treated with those strains. In particular, the combination of SYM01315+SYM15901 showed up to 40% beneficial effect on wheat plants in both normal and water stressed conditions relative to formulation only treated wheat seedlings. SYM01315 is able to utilize L-proline as a sole carbon substrate based on BIOLOG assays. Similarly, proline was also a sole carbon source for SYM15901. Taken together, it is highly suggestive that the SYM strains' ability to efficiently utilize proline that gets elevated under biotic stresses as water and salt is a potential key component in conferring water stress plant protection.

Rolling Paper Assay for Evaluating Seed Germination and Seedling Drought Tolerance Soy seeds were sterilized and coated with the appropriate endophyte as described in Example 5. Regular weight seed germination paper (Anchor Paper Co.) was used for testing the effect of the endophytes on soy under water limiting stress. Briefly, the paper was custom cut to 60 cm×15 cm and soaked in sterile water. Sixteen seeds were placed along the middle (7.5 cm from the edge) of longest axis of a piece of paper, equidistant from one another. A second pre-soaked piece of paper was layered on top of the seeds and the "sandwich" created in this way was rolled from one end, being careful to maintain the seeds in position, to form a tube 15 cm tall and approximately 5 cm in diameter. Each paper roll was placed vertically inside a sterile glass jar with a lid to hold water absorbed in rolling paper, and was then incubated in a growth chamber set at 22° C., 60% relative humidity, in the dark for two days. Then, the jars were opened and incubated for two more days with the conditions changed to 12 hours daylight (300-350 micro Einstein) 12 hours dark and 70% relative humidity.

Data scoring and analyzes were performed as described in Example 5, except for experiment shown in Table 44A, where measurements were taken by hand, and the data are showed in a binning of % increase in root length vs fungal formulation control: >0%=0, 0-5%=1, 5-10%=2, 10-15%=3.

The effects of bacterial and fungal endophytes belonging to core OTUs, and combinations of bacterial and fungal endophytes, on the growth of soy seeds in a rolling paper assay is shown in Tables 43 and 44A and B.

TABLE 43A

Assay for soy seedling growth in rolling paper assay, where soy seeds were treated with core bacterial endophytes. Measurements for manual scoring of rolling paper soy water stress assay for core fungal strains were done according to the scale established previously. Briefly the score that was used was: <0% = 0; >0% = 1; >5% = 2, and >10% = 3. The percentage indicates percent change of treatments relative to formulation. The mean root lengths of the SYM treated biological replicates of soy seedlings were divided relative the mean root lengths of the fungal formulation.

| Strain | SEQ ID NO. | Water stress |
| --- | --- | --- |
| SYM00003 | 3588 | 0 |
| SYM00013 | 3590 | 3 |
| SYM00017A | 3591 | 3 |
| SYM00018 | 3592 | 2 |
| SYM00020 | 3593 | 2 |
| SYM00050 | 3600 | 1 |
| SYM00070 | 3607 | 3 |
| SYM00219 | 3624 | 2 |
| SYM00525 | 3632 | 3 |
| SYM00538A | 3633 | 3 |
| SYM00538i | 3635 | 3 |
| SYM00627 | 3648 | 3 |
| SYM00987 | 3667 | 3 |
| SYM00991 | 3669 | 1 |
| SYM00628 | 3649 | 1 |

Under water stress, 73.33% of bacterial strains showed beneficial effect compared to control higher than 20% including SYM00018, SYM00020 and SYM00219. Strains SYM00013, SYM00017A, SYM00070, SYM00525, SYM00538A, SYM00538i, SYM00627, SYM00987 (53.3% of total) showed beneficial effect higher than 40%.

TABLE 44A

Assay for soy seedling growth in rolling paper assay, where soy seeds were treated with core fungal endophytes. Measurements for manual scoring of rolling paper soy water stress assay for core fungal strains were done according to the scale established previously. Briefly the score that was used was: <0% = 0; >0% = 1; >5% = 2, and >10% = 3. The percentage indicates percent change of treatments relative to formulation. The mean root lengths of the SYM treated biological replicates of soy seedlings were divided relative the mean root lengths of the fungal formulation.

| Strain | SEQ ID NO. | Water stress |
| --- | --- | --- |
| SYM00066 | 3605 | 0 |
| SYM00122 | 3611 | 3 |
| SYM00123 | 3612 | 2 |
| SYM00124 | 3613 | 3 |
| SYM00135 | 3615 | 3 |
| SYM00741a | 3657 | 0 |
| SYM00741b | 3658 | 3 |
| SYM00795 | 3660 | — |
| SYM00854 | 3661 | 0 |
| SYM00880 | 3662 | 1 |
| SYM01303 | 3673 | 0 |
| SYM01315 | 3677 | 3 |
| SYM01327 | 3680 | 2 |
| SYM01333 | 3682 | 3 |
| SYM15811 | 3683 | 3 |
| SYM15820 | 3684 | 1 |
| SYM15821 | 3685 | 2 |
| SYM15831 | 3688 | 3 |
| SYM15870 | 3692 | 1 |
| SYM15872 | 3693 | 0 |
| SYM15890 | 3694 | 3 |
| SYM15901 | 3695 | 3 |
| SYM15920 | 3696 | 0 |
| SYM15932 | 3699 | 3 |
| SYM15939 | 3700 | 0 |

Water stress experiments examining the effect of core fungal SYM strains on soy plants revealed several very promising strains that that exhibited over 10% improved seedling root length relative to formulation only treated seedlings. These were SYM00122, SYM00124, SYM00135, SYM00741b, SYM01315, SYM01333, SYM15811, SYM15831, SYM15890, SYM15901, and SYM15932. Three strains had >5% improved root length, while three showed >0% increased root length compared to formulation only treated plants.

Eight of these eleven had the ability to utilize L-proline as a sole carbon nutrient in BIOLOG substrate tests. It is well established that proline level is elevated in plants exposed to salt and water stresses. This data may indicate that although the SYM strains originated from different genera, they may share similar underlying mechanisms when it comes to affecting the plants phenotype in mitigating plant drought stress.

TABLE 44B

Assay for soy seedling growth in rolling paper assay, where soy seeds were treated with combinations of core fungal endophytes. Measurements for manual scoring of rolling paper soy water stress assay for core fungal strains were done according to the scale established previously. Briefly the score that was used was: <0% = 0; >0% = 1; >5% = 2, and >10% = 3. The percentage indicates percent change of treatments relative to formulation. The mean root lengths of the SYM treated biological replicates of soy seedlings were divided relative the mean root lengths of the fungal formulation.

| Strain 1 | SEQ ID NO. | Strain 2 | SEQ ID NO. | Water stress |
| --- | --- | --- | --- | --- |
| SYM15901 | 3695 | SYM15821 | 3685 | 1 |
| SYM15890 | 3694 | SYM01333 | 3682 | 0 |
| SYM15890 | 3694 | SYM00741a | 3657 | 1 |
| SYM15890 | 3694 | SYM01315 | 3677 | 2 |
| SYM15890 | 3694 | SYM15901 | 3695 | 3 |
| SYM15890 | 3694 | SYM15870 | 3692 | 2 |
| SYM15821 | 3685 | SYM15870 | 3692 | 2 |
| SYM15811 | 3683 | SYM00122 | 3611 | 3 |
| SYM15811 | 3683 | SYM15890 | 3694 | 0 |

TABLE 44B-continued

Assay for soy seedling growth in rolling paper assay, where soy seeds
were treated with combinations of core fungal endophytes. Measurements
for manual scoring of rolling paper soy water stress assay for core
fungal strains were done according to the scale established previously.
Briefly the score that was used was: <0% = 0; >0% = 1; >5% = 2,
and >10% = 3. The percentage indicates percent change of treatments
relative to formulation. The mean root lengths of the SYM
treated biological replicates of soy seedlings were divided
relative the mean root lengths of the fungal formulation.

| Strain 1 | SEQ ID NO. | Strain 2 | SEQ ID NO. | Water stress |
|---|---|---|---|---|
| SYM15811 | 3683 | SYM01333 | 3682 | 0 |
| SYM15811 | 3683 | SYM01315 | 3677 | 0 |
| SYM15811 | 3683 | SYM00066 | 3605 | 0 |
| SYM15811 | 3683 | SYM15870 | 3692 | 0 |
| SYM01315 | 3677 | SYM15901 | 3695 | 0 |
| SYM01315 | 3677 | SYM00124 | 3613 | 3 |

A beneficial plant microbiome is likely made up of multiple strains that occupy stress protection niches within the plant. This was evaluated in the rolling paper assay to test the improvement on the plant phenotype conferred by inoculation with multiple fungal strains. The top three performers all utilize a-Cyclodextrin, which is a trait shared by all of the single fungi treatments which incurred the largest positive plant phenotypic change. The majority of the strains that are party of the combos also show similar patterns when it comes to siderophore and auxin production. This may indicate that although they come from different genera, they may occupy similar niches when it comes to affecting the plants phenotype when helping the plant deal with drought stress.

Example 10

Trials to Full Plant Maturity to Demonstrate Performance in Commercial Field Setting Corn was grown at two locations in the United States. Six replicate plots were sown for each treatment and variety combination. Control plots were planted for formulation treated seeds. Seeds were sown in an irrigated field in plots of 10 by 40 ft arranged in a randomized complete block design. Four rows were planted per plot with a row spacing of 30 inches. Seeding density at Location 1 was 576 g per acre. Seeding density at Location was 35,000 seeds per acre. SPAD readings were taken at Location 2 only for 10 plants per plot on three months after planting (one month before harvest) to measure chlorophyll content of leaves. The interior 2 rows were harvested by combine. Grain yield per plot, grain moisture, and test weight were assessed. Yield was adjusted for grain moisture content to a storage moisture of 14% (i.e. dry bushels per acre for combine harvest). Data shown for both locations are shown in Tables 45A and 45B.

TABLE 45A

Rainfed trial in Location 1.

| Treatment | Combine yield (dry bu/ac) |
|---|---|
| Bacterial formulation control | 101.77 |
| SYM00033 | 119.96 |

TABLE 45B

Rainfed trial in Location 2.

| Treatment | SPAD | Combine yield (dry bu/ac) |
|---|---|---|
| Fungal formulation control | 53.72 | 88.78 |
| SYM00066 [i] | 54.54 | 95.17 |
| Bacterial formulation control | 54.35 | 91.76 |
| SYM00074 [ii] | 55.95 | 85.54 |

[i] Compare to fungal formulation control
[ii] Compare to bacterial formulation control For combine yield, SYM00033 showed a substantial increase in dry bushels per acre compared to formulation treated controls. As an indicator of leaf chlorophyll content, SYM00066 showed a slight increase in SPAD readings compared to the fungal formulation control. For combine yield, SYM00066 showed a substantial increase in dry bushels per acre compared to the fungal formulation control. As an indicator of leaf chlorophyll content, SYM00074 showed a slight increase in SPAD readings compared to the bacterial formulation control.

Other embodiments will be apparent to those skilled in the art from consideration of the specification and practice of the embodiments. Consider the specification and examples as exemplary only, with a true scope and spirit being indicated by the following claims.

Lengthy table referenced here

US09408394-20160809-T00001

Please refer to the end of the specification for access instructions.

Lengthy table referenced here

US09408394-20160809-T00002

Please refer to the end of the specification for access instructions.

Lengthy table referenced here

US09408394-20160809-T00003

Please refer to the end of the specification for access instructions.

Lengthy table referenced here

US09408394-20160809-T00004

Please refer to the end of the specification for access instructions.

Lengthy table referenced here

US09408394-20160809-T00005

Please refer to the end of the specification for access instructions.

Lengthy table referenced here
US09408394-20160809-T00006
Please refer to the end of the specification for access instructions.

Lengthy table referenced here
US09408394-20160809-T00007
Please refer to the end of the specification for access instructions.

Lengthy table referenced here
US09408394-20160809-T00008
Please refer to the end of the specification for access instructions.

Lengthy table referenced here
US09408394-20160809-T00009
Please refer to the end of the specification for access instructions.

Lengthy table referenced here
US09408394-20160809-T00010
Please refer to the end of the specification for access instructions.

Lengthy table referenced here
US09408394-20160809-T00011
Please refer to the end of the specification for access instructions.

Lengthy table referenced here
US09408394-20160809-T00012
Please refer to the end of the specification for access instructions.

Lengthy table referenced here
US09408394-20160809-T00013
Please refer to the end of the specification for access instructions.

Lengthy table referenced here
US09408394-20160809-T00014
Please refer to the end of the specification for access instructions.

Lengthy table referenced here
US09408394-20160809-T00015
Please refer to the end of the specification for access instructions.

Lengthy table referenced here
US09408394-20160809-T00016
Please refer to the end of the specification for access instructions.

Lengthy table referenced here
US09408394-20160809-T00017
Please refer to the end of the specification for access instructions.

Lengthy table referenced here
US09408394-20160809-T00018
Please refer to the end of the specification for access instructions.

Lengthy table referenced here
US09408394-20160809-T00019
Please refer to the end of the specification for access instructions.

Lengthy table referenced here
US09408394-20160809-T00020
Please refer to the end of the specification for access instructions.

Lengthy table referenced here
US09408394-20160809-T00021
Please refer to the end of the specification for access instructions.

Lengthy table referenced here
US09408394-20160809-T00022
Please refer to the end of the specification for access instructions.

Lengthy table referenced here
US09408394-20160809-T00023
Please refer to the end of the specification for access instructions.

Lengthy table referenced here
US09408394-20160809-T00024
Please refer to the end of the specification for access instructions.

Lengthy table referenced here
US09408394-20160809-T00025
Please refer to the end of the specification for access instructions.

Lengthy table referenced here
US09408394-20160809-T00026
Please refer to the end of the specification for access instructions.

Lengthy table referenced here
US09408394-20160809-T00027
Please refer to the end of the specification for access instructions.

Lengthy table referenced here
US09408394-20160809-T00028
Please refer to the end of the specification for access instructions.

Lengthy table referenced here
US09408394-20160809-T00029
Please refer to the end of the specification for access instructions.

Lengthy table referenced here
US09408394-20160809-T00030
Please refer to the end of the specification for access instructions.

Lengthy table referenced here
US09408394-20160809-T00031
Please refer to the end of the specification for access instructions.

REFERENCES

Abarenkov, K., R. Henrik Nilsson, K.-H. Larsson, I. J. Alexander, U. Eberhardt, S. Erland, K. Høiland, R. Kjøller, E. Larsson, T. Pennanen, R. Sen, A. F. S. Taylor, L. Tedersoo, B. M. Ursing, T. Vrålstad, K. Liimatainen, U. Peintner, and U. Kõljalg. 2010. The UNITE database for molecular identification of fungi—recent updates and future perspectives. New Phytologist 186:281-285.

Edgar, R. C. 2010. Search and clustering orders of magnitude faster than BLAST. Bioinformatics 26:2460-2461.

Edgar, R. C. 2013. UPARSE: highly accurate OTU sequences from microbial amplicon reads. Nature methods 10:996-8.

Fierer, N., J. W. Leff, B. J. Adams, U. N. Nielsen, S. T. Bates, C. L. Lauber, S. Owens, J. a. Gilbert, D. H. Wall, and J. G. Caporaso. 2012. Cross-biome metagenomic analyses of soil microbial communities and their functional attributes. Proceedings of the National Academy of Sciences.

Lundberg, D. S., S. Yourstone, P. Mieczkowski, C. D. Jones, and J. L. Dangl. 2013. Practical innovations for high-throughput amplicon sequencing. Nature methods 10:999-1002.

McDonald, D., M. N. Price, J. Goodrich, E. P. Nawrocki, T. Z. DeSantis, A. Probst, G. L. Andersen, R. Knight, and P. Hugenholtz. 2012. An improved Greengenes taxonomy with explicit ranks for ecological and evolutionary analyses of bacteria and archaea. The ISME journal 6:610-8.

McGuire, K. L., S. G. Payne, M. I. Palmer, C. M. Gillikin, D. Keefe, S. J. Kim, S. M. Gedallovich, J. Discenza, R. Rangamannar, J. a Koshner, A. L. Massmann, G. Orazi, A. Essene, J. W. Leff, and N. Fierer. 2013. Digging the New York City Skyline: soil fungal communities in green roofs and city parks. PloS one 8:e58020.

R Core Team. 2013. R: A Language and Environment for Statistical Computing. R Foundation for Statistical Computing, Vienna, Austria.

Wang, Q., G. M. Garrity, J. M. Tiedje, and J. R. Cole. 2007. Naive Bayesian classifier for rapid assignment of rRNA sequences into the new bacterial taxonomy. Applied and environmental microbiology 73:5261-7.

Abarenkov, K., R. Henrik Nilsson, K.-H. Larsson, I. J. Alexander, U. Eberhardt, S. Erland, K. Høiland, R. Kjøller, E. Larsson, T. Pennanen, R. Sen, A. F. S. Taylor, L. Tedersoo, B. M. Ursing, T. Vrålstad, K. Liimatainen, U. Peintner, and U. Kõljalg. 2010. The UNITE database for molecular identification of fungi—recent updates and future perspectives. New Phytologist 186:281-285.

Edgar, R. C. 2013. UPARSE: highly accurate OTU sequences from microbial amplicon reads. Nature methods 10:996-8.

Fierer, N., J. W. Leff, B. J. Adams, U. N. Nielsen, S. T. Bates, C. L. Lauber, S. Owens, J. a. Gilbert, D. H. Wall, and J. G. Caporaso. 2012. Cross-biome metagenomic analyses of soil microbial communities and their functional attributes. Proceedings of the National Academy of Sciences.

Lundberg, D. S., S. Yourstone, P. Mieczkowski, C. D. Jones, and J. L. Dangl. 2013. Practical innovations for high-throughput amplicon sequencing. Nature methods 10:999-1002.

McDonald, D., M. N. Price, J. Goodrich, E. P. Nawrocki, T. Z. DeSantis, A. Probst, G. L. Andersen, R. Knight, and P. Hugenholtz. 2012. An improved Greengenes taxonomy with explicit ranks for ecological and evolutionary analyses of bacteria and archaea. The ISME journal 6:610-8.

McGuire, K. L., S. G. Payne, M. I. Palmer, C. M. Gillikin, D. Keefe, S. J. Kim, S. M. Gedallovich, J. Discenza, R. Rangamannar, J. a Koshner, A. L. Massmann, G. Orazi, A. Essene, J. W. Leff, and N. Fierer. 2013. Digging the New York City Skyline: soil fungal communities in green roofs and city parks. PloS one 8:e58020.

R Core Team. 2013. R: A Language and Environment for Statistical Computing. R Foundation for Statistical Computing, Vienna, Austria.

Rideout J R, He Y, Navas-Molina J A, Walters W A, Ursell L K, Gibbons S M, Chase J, McDonald D, Gonzalez A, Robbins-Pianka A, Clemente J C, Gilbert J A, Huse S M, Zhou H, Knight R, Caporaso J G. (2014) Subsampled open-reference clustering creates consistent, comprehensive OTU definitions and scales to billions of sequences. Peed 2:e545https://dx.doi.org/10.7717/peerj.545

Wang, Q., G. M. Garrity, J. M. Tiedje, and J. R. Cole. 2007. Naive Bayesian classifier for rapid assignment of rRNA sequences into the new bacterial taxonomy. Applied and environmental microbiology 73:5261-7.

Barua, D., Kim, J., & Reed, J. L. (2010) An automated phenotype-driven approach (GeneForce) for refining metabolic and regulatory models. PLoS Comput Biol, 6(10), e1000970.

Blumenstein, K., Albrectsen, B. R., Martin, J. A., Hultberg, M., Sieber, T. N., Helander, M., & Witzell, J. (2015) Nutritional niche overlap potentiates the use of endophytes in biocontrol of a tree disease. BioControl, 1-13.

Borglin, S., Joyner, D., DeAngelis, K. M., Khudyakov, J., D'haeseleer, P., Joachimiak, M. P., & Hazen, T. (2012) Application of phenotypic microarrays to environmental microbiology. Current opinion in biotechnology, 23(1), 41-48.

Garland, J. L., & Mills, A. L. (1991) Classification and characterization of heterotrophic microbial communities on the basis of patterns of community-level sole-carbon-source utilization. Applied and environmental microbiology, 57(8), 2351-2359.

Siemens, N., Fiedler, T., Normann, J., Klein, J., Munch, R., Patenge, N., & Kreikemeyer, B. (2012) Effects of the ERES pathogenicity region regulator Ralp3 on *Streptococcus pyogenes* serotype M49 virulence factor expression. Journal of bacteriology, 194(14), 3618-3626.

Chen, T. H., & Murata, N. (2002). Enhancement of tolerance of abiotic stress by metabolic engineering of betaines and other compatible solutes. Current opinion in plant biology, 5(3), 250-257.

Rideout J R, He Y, Navas-Molina J A, Walters W A, Ursell L K, Gibbons S M, Chase J, McDonald D, Gonzalez A, Robbins-Pianka A, Clemente J C, Gilbert J A, Huse S M, Zhou H, Knight R, Caporaso J G. (2014) Subsampled open-reference clustering creates consistent, comprehensive OTU definitions and scales to billions of sequences. *PeerJ* 2:e545 https://dx.doi.org/10.7717/peerj.545

LENGTHY TABLES

The patent contains a lengthy table section. A copy of the table is available in electronic form from the USPTO web site (http://seqdata.uspto.gov/?pageRequest=docDetail&DocID=US09408394B2). An electronic copy of the table will also be available from the USPTO upon request and payment of the fee set forth in 37 CFR 1.19(b)(3).

SEQUENCE LISTING (3813 sequences)

SEQ ID NO: 1 - DNA, 253 bp, Actinotalea sp.
  Actinobacteria; Cellulomonadaceae; Actinotalea
tacgtagggcgcaagcgttgtccggaattattgggcgtaaagagctcgtaggcggtttgtcgcgtctgctgtgaaaacccgaggctcaacctcggtcctgcagtgggtacgggcagactagagtgcggtaggggagactggaattcctggtgtagcggtggaatgcgcagatatcaggaggaacaccgatggcgaaggcaggtctctgggccgcaactgacgctgaggagcgaaagcgtggggagcgaacagg

SEQ ID NO: 2 - DNA, 253 bp, Brachybacterium sp.
  Actinobacteria; Dermabacteraceae; Brachybacterium
tacgtagggcgcaagcgttgtccggaattattgggcgtaaagagctcgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgaggagcgaaagcatgggtagcgaacagg

SEQ ID NO: 3 - DNA, 253 bp, Unknown
  Description of Unknown: bacterium polynucleotide
  Actinobacteria; Microbacteriaceae
tacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 4 - DNA, 253 bp, Unknown
  Description of Unknown: bacterium polynucleotide
  Actinobacteria; Microbacteriaceae
tacgtagggtgcaagcgttatccggaattattgggcgtaaagagctcgtaggcggtttgtcgcgtctgctgtgaaaactggaggctcaacctccagcctgcagtgggtacgggcaaactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 5 - DNA, 253 bp, Microbacterium sp.
  Actinobacteria; Microbacteriaceae; Microbacterium
tacgtagggcgcaagcgctatccggaattattgggcgtaaggagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctggggagcgaaagggtggggagcaaacagg

SEQ ID NO: 6 - DNA, 253 bp, Micrococcus sp.
  Actinobacteria; Micrococcaceae; Micrococcus
tacgtagggtgcgagcgttatccggaattattgggcgtaaggagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgagggcaggtctctgggctgtaactgacgctgaggagcgaaagcatggggagcgaacagg

SEQ ID NO: 7 - DNA, 253 bp, Aeromicrobium sp.
  Actinobacteria; Nocardioidaceae; Aeromicrobium
tacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacagg

SEQ ID NO: 8 - DNA, 253 bp, Unknown
  Description of Unknown: bacterium polynucleotide
  Actinobacteria; Streptomycetaceae
tacgtagggcgcaagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 9 - DNA, 253 bp, Methylobacterium sp.
  Alphaproteobacteria; Methylobacteriaceae; Methylobacterium
tacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 10 - DNA, 253 bp, Rhizobium sp.
  Alphaproteobacteria; Rhizobiaceae; Rhizobium
tacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 11 - DNA, 253 bp, Sphingomonas yabuuchiae
  Alphaproteobacteria; Sphingomonadaceae; Sphingomonas yabuuchiae
tacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacagg

SEQ ID NO: 12 - DNA, 253 bp, Bacillus sp.
  Bacilli; Bacillaceae; Bacillus
tacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 13 - DNA, 253 bp, Bacillus firmus
  Bacilli; Bacillaceae; Bacillus firmus
tacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 14 - DNA, 253 bp, Bacillus cereus
  Bacilli; Bacillaceae; Bacillus cereus
tacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacagg

SEQ ID NO: 15 - DNA, 252 bp, Unknown
  Description of Unknown: bacterium polynucleotide
  Bacilli; Paenibacillaceae
tacgtagggggcaagcgttgtccggaattattgggcgtaaagcgcgtgcaggcggcttgttaagttgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 16 - DNA, 252 bp, Paenibacillus sp.
  Bacilli; Paenibacillaceae; Paenibacillus
tacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 17 - DNA, 252 bp, Paenibacillus sp.
  Bacilli; Paenibacillaceae; Paenibacillus
tacgtagggggcaagcgttgtccggaattattgggcgtaaagcgcgcgcaggcggttatttaagtctggtgtttaatcctggggctcaaccccgggtcgcaccggaaactgggtaacttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacagg

SEQ ID NO: 18 - DNA, 253 bp, Unknown
  Description of Unknown: bacterium polynucleotide
  Bacilli; Planococcaceae
tacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 19 - DNA, 253 bp, Staphylococcus sp.
  Bacilli; Staphylococcaceae; Staphylococcus
tacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 20 - DNA, 253 bp, Ralstonia sp.
  Betaproteobacteria; Oxalobacteraceae; Ralstonia
tacgtagggtccaagcgttaatcggaattactgggcgtaaagcgtgcgcaggcggttgtgcaagaccgatgtgaaatccccgggcttaacctgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 21 - DNA, 253 bp, Dyadobacter sp.
  Cytophagia; Cytophagaceae; Dyadobacter
tacggagggtgcgagcgttgtccggatttattgggtttaaagggtgcgtaggtggctgtttaagtcagtggtgaaatacggttgctcaacaatcgaggtgccattgatactgaatagcttgaaataattggaggctgccggaatggatggtgtagcggtgaaatgcatagatatcatccagaacaccgattgcgaaggcaggtggctacgattggtttgacactgaggcacgaaagcatggggagcaaacagg

SEQ ID NO: 22 - DNA, 253 bp, Chryseobacterium sp.
  Flavobacteriia; Weeksellaceae; Chryseobacterium
tacggagggtgcaagcgttatccggatttattgggtttaaagggtccgtaggcggatctgtaagtcagtggtgaaatctcatagcttaactatgaaactgccattgatactgcaggtcttgagtaaagtagaagtggctggaataagtagtgtagcggtgaaatgcatagatattacttagaacaccaattgcgaaggcaggtcactatgttttaactgacgctgatggacgaaagcgtggggagcgaacagg

SEQ ID NO: 23 - DNA, 253 bp, Flavobacterium succinicans
  Flavobacteriia; Flavobacteriaceae; Flavobacterium succinicans
tacggaggatccaagcgttatccggaatcattgggtttaaagggtctgtaggcggtcttgtaagtcagtggtgaaagcccatcgctcaacggtggaacggccattgatactgctggacttgaattattgggaagcaactagaatatgtagtgtagcggtgaaatgcttagagattacatggaataccaattgcgaaggcaggttgctaccaatggattgacgctgatggacgaaagcgtgggtagcgaacagg

SEQ ID NO: 24 - DNA, 253 bp, Unknown
  Description of Unknown: bacterium polynucleotide
  Gammaproteobacteria; Enterobacteriaceae
gacagaggatgcaagcgttatccggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 25 - DNA, 253 bp, Unknown
  Description of Unknown: bacterium polynucleotide
  Gammaproteobacteria; Enterobacteriaceae
tacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatgtgggggaacaccgatggcgaaggcggccccctggacaaagactgacgctcaggtgcgaaagcgtggggagcaaacagg

SEQ ID NO: 26 - DNA, 253 bp, Unknown
  Description of Unknown: bacterium polynucleotide
  Gammaproteobacteria; Enterobacteriaceae
tacggagggtgcaagcgttaatcggaattgctgggcgtaaagcgcacgcaggcagtctgtcaagtcggatgtgaaatccccgggctcaacctggggactgcattcgaaactggcaggctagagtctcgtagaggggggtagaattccaggtgtagcggtggaatgcgtagagatctggaggaataccggtggcgaaggcggccccctggacaaagactgacgctcaggtgcgaaagcgtggggagcaaacagg

SEQ ID NO: 27 - DNA, 253 bp, Enterobacter sp.
  Gammaproteobacteria; Enterobacteriaceae; Enterobacter
tacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggagtagcggtgaaatgcgtagagatctggaggaataccggtggcgaaggcggccccctggacgaagactgacgctcaggtgcgaaagcgtggggagcaaacagg

SEQ ID NO: 28 - DNA, 253 bp, Enterobacter hormaechei
  Gammaproteobacteria; Enterobacteriaceae; Enterobacter hormaechei
tacgtagggtgcgagcgttaatcggaattactgggcgtaaagcgcacgcaggcggtctgtcaagtcggatgtgaaatccccgggctcaacctgggaactgcattcgaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 29 - DNA, 253 bp, Escherichia coli
  Gammaproteobacteria; Enterobacteriaceae; Escherichia coli
tacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgatgctcaggtgcgaaagcgtggggagcaaacagg

SEQ ID NO: 30 - DNA, 253 bp, Pantoea agglomerans
  Gammaproteobacteria; Enterobacteriaceae; Pantoea agglomerans
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 31 - DNA, 253 bp, Pantoea sp.
  Gammaproteobacteria; Enterobacteriaceae; Pantoea
tacggagggtgcaagcgttaatcggaattactgggcgtaaagcacacgcaggcggtctgttaagtcagatgtgaaatccccgggcttaacctgggaactgcatttgaaactggcaggcttgagcctcgtagaggggggtagaattccaggtgtagcggtgaaatgcgtagggatctggaggaataccggtggcgaaggcggccccctggacgaagactgacgctcaggtgcgaaagcgtggggagcgaacaac

SEQ ID NO: 32 - DNA, 253 bp, Pantoea ananatis
  Gammaproteobacteria; Enterobacteriaceae; Pantoea ananatis
gacggggggggcaagtgttcttcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 33 - DNA, 253 bp, Pseudomonas sp.
  Gammaproteobacteria; Pseudomonadaceae; Pseudomonas
tacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacagg

SEQ ID NO: 34 - DNA, 253 bp, Unknown
  Description of Unknown: bacterium polynucleotide
  Gammaproteobacteria; Xanthomonadaceae
tacgaagggtgcaagcgttactcggaattactgggcgtaaagcgtgcgtaggtggtgatttaagtcagatgtgaaagccctgggctcaacctgggaactgcatttgatactgggtcactagagtgcggtagaggatagcggaattcctggtgtagcagtgaaatgcgtagagatcaggaggaacatccgtggcgaaggcggctatctgggccagcactgacactgaggcacgaaagcgtggggagcaaacagg

SEQ ID NO: 35 - DNA, 253 bp, Luteibacter rhizovicinus
  Gammaproteobacteria; Xanthomonadaceae; Luteibacter rhizovicinus
tacggagggtgcaagcgttaatcggaattactgggcgtaaagcgtgcgtaggcggttcgttaagtctgctgtgaaagccccgggctcaacctgggaatggcagtggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacagg

SEQ ID NO: 36 - DNA, 253 bp, Stenotrophomonas sp.
  Gammaproteobacteria; Xanthomonadaceae; Stenotrophomonas
tacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacgtccatggcgaaggcatctacctggaccaacactgacactgaggcacgaaagcgtggggagcaaacggg

SEQ ID NO: 37 - DNA, 253 bp, Stenotrophomonas sp.
  Gammaproteobacteria; Xanthomonadaceae; Stenotrophomonas
tacgaagggtgcaagcgttactcggaattactgggcgtaaagcgtgcgtaggtggttatttaagtccgttgtgaaagccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacagg

SEQ ID NO: 38 - DNA, 253 bp, Stenotrophomonas sp.
  Gammaproteobacteria; Xanthomonadaceae; Stenotrophomonas
tacagagggtgcaagcgttaatcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctacctggaccaacactgacactgaggcacgaaagcgtggggagcaaacagg

SEQ ID NO: 39 - DNA, 253 bp, Xanthomonas sp.
  Gammaproteobacteria; Xanthomonadaceae; Xanthomonas
tacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacagg

SEQ ID NO: 40 - DNA, 253 bp, Unknown
  Description of Unknown: bacterium polynucleotide
  Chloracidobacteria
tacgaagggggctagcgttgttcggatttactgggcgtaaagcgcacgtaggcggatcgttaagtcgggggtgaaagcccggggctcaaccccggaactgctttcgaaactgctgagctagagtacagaaggggcaaccggaattcccagtgtagcggtgaaatgcgtagatattgggaagaacacctgaggcgaaggcgggttgctgggctgatactgacgctgaggcgcgaaagccaggggagcaaacggg

SEQ ID NO: 41 - DNA, 254 bp, Unknown
  Description of Unknown: bacterium polynucleotide
  Chloracidobacteria
tacggggggagcaagcgttgttcggatttactgggcgtaaagggcgcgtaggcggtcgtgacaagtcacttgtgaaatctccgggcttaactcggaacggtcaagtgatactgtcggactagagtacagaaggggcaactggaattctcggtgtagcggtgaaatgcgtagatatcgagaggaacacctgcggcgaaggcgggttgctgggctgatactgacgctgaggcgcgaaagccaggggagcgaacggg

SEQ ID NO: 42 - DNA, 254 bp, Unknown
  Description of Unknown: bacterium polynucleotide
  Chloracidobacteria
tacggggggagcaagcgttgttcggatttactgggcgtaaagggcgcgtaggcggccactgcaagtcagttgtgaaatctccgggcttgacccggaaaggtcaactgatactgcagggctagagtgcagaaggggcaactggaattctcggtgtagcggtgaaatgcgtagatatcgagaggaacacctgcggcgaaggcgggttgctgggctgacactgacgctgaggcgcgaaagccaggggagcgaacggg

SEQ ID NO: 43 - DNA, 253 bp, Unknown
  Description of Unknown: bacterium polynucleotide
  Chloracidobacteria
tacggggggagcaagcgttgttcggatttactgggcgtaaagggcgcgtaggcggcgcaacaagtcacttgtgaaatctccgggcttaacccggagcggccaagtgatactgtcgtgctagagtgcggaaggggctactggaattctcggtgtagcggtgaaatgcgtagatatcgagaggaacacctgtggcgaaggcgggtagctgggccgacactgacgctgaggcgcgaaagctaggggagcgaatggg

SEQ ID NO: 44 - DNA, 253 bp, Unknown
  Description of Unknown: bacterium polynucleotide
  Chloracidobacteria
tacggggggagcaagcgttgttcggatttactgggcgtaaagggcgcgtaggcggcgcgacaagtcacttgtgaaatctctgggctcaacccagaacggtcaagtgatactgtcgtgctagagtgcggaaggggcaactggaattcttggtgtagcggtgaaatgcgtagatatcaagaggaacacctgcggcgaaggcgggttgctgggccgacactgacgctgaggcgcgaaagctaggggagcgaacggg

SEQ ID NO: 45 - DNA, 253 bp, Unknown
  Description of Unknown: bacterium polynucleotide
  Chloracidobacteria
tacggggggagcaagcgttgttcggatttactgggcgtaaagggcgcgtaggcggcgcaacaagtcgcttgtgaaatctccgggcttaactcggagcggccaagtgatactgtcgtgctagagtgcggaaggggcaactggaattctcggtgtagcggtgaaatgcgtagatatcgagaggaacacctgcggcgaaggcgggttgctgggctgacactgacgctgaggcgcgaaagccaggggagcgaacggg

SEQ ID NO: 46 - DNA, 254 bp, Unknown
  Description of Unknown: bacterium polynucleotide
  Chloracidobacteria
tacggggggagcaagcgttgttcggatttactgggcgtaaagggcgcgtaggcggccaccgcaagtcgactgtgaaatctccgggcttaactcggaaaggtcagccgatactgcggggctagagtgcagaaggggcaactggaattctcggtgtagcggtgaaatgcgtagatatcgagaggaacacctgcggcgaaggcgggttgctgggctgacactgatgctgaggcgcgaaagctaggggagcgaacggg

SEQ ID NO: 47 - DNA, 254 bp, Unknown
  Description of Unknown: bacterium polynucleotide
  Chloracidobacteria
tacggggggagcaagcgttgttcggatttactgggcgtaaagggcgcgtaggcggccaccgcaagtcaattgtgaaatctccgggcttaactcggaaaggtcaactgatactgcggggctagagtgcggaaggggcaactggaattctcggtgtagcggtgaaatgcgtagatatcgagagggacacctgcggcgaaggcgggttgctgggccgacactgacgctgatgcgcgaaagccaggggagcgaacggg

SEQ ID NO: 48 - DNA, 253 bp, Unknown
  Description of Unknown: bacterium polynucleotide
  Chloracidobacteria
tacggggggagcaagcgttgttcggatttactgggcgtaaagagcgcgtaggcggcgtgacaagtcacttgtgaaatctccgggcttaacccggagcggtcaagtgatactgtcgtgctagagtgcggaaggggcaactggaattctcggtgtagcggtgaaatgcgtagatatcgagaggaacacctgcggcgaaggcgggttgctgggccgacactgacgctgaggcgcgaaagccaggggagcgagcggg

SEQ ID NO: 49 - DNA, 254 bp, Unknown
  Description of Unknown: bacterium polynucleotide
  Chloracidobacteria
tacgaagggtgcaagcgttgttcggatttactgggcgtaaagggcgcgtaggcggccaccgcaagtcagttgtgaaatctctgggcttaacccagaaaggtcaactgatactgcggggctagagtgcagaaggggcaactggaattctcggtgtagcggtgaaatgcgtagatatcgagaggaacacctgcggcgaaggcgggttgctgggctgacactgacgctgaggcgcgaaagctaggggagcgaacggg

SEQ ID NO: 50 - DNA, 254 bp, Unknown
  Description of Unknown: bacterium polynucleotide
  Chloracidobacteria
tacggggggagcaagcgttgttcggatttactgggcgtaaagggcgcgtaggcggtcagcacaagtcagttgtgaaatctccgggcttaactcggaaaggtcaactgatactgtgcgactagagtgcggaaggggcaactggaattctcggtgtagcggtgaaatgcgtagatatcgagaggaacacctgcggcgaaggcgggttgctgggccgacactgacgctgatgcgcgaaagccaggggagcgaacggg

SEQ ID NO: 51 - DNA, 253 bp, Unknown
  Description of Unknown: bacterium polynucleotide
  Chloracidobacteria
tacgtaggtggcaagcgttgttcggaattattgggcgtaaagggcgcgtaggcggtttgttaagtcagctgtgaaagcccggggctcaaccccggagggtcgactgatactggcaaactagagtacggaagaggtagctggaattcccggtgtagcggtgaaatgcgtagatatcgggaggaacacccgaggcgaaggcgggctactgggccgatactgacgctgatgcgcgaaagcgtggggagcaaacagg

SEQ ID NO: 52 - DNA, 253 bp, Unknown
  Description of Unknown: bacterium polynucleotide
  Chloracidobacteria
tacggggggagcaagcgttgttcggatttactgggcgtaaagggcgcgtaggcggcgtggtaagtcacttgtgaaatctccgggcttaacccggaaaggtcaagtgatactgctgtgctagagtgcggaaggggcaactggaattctcggtgtagcggtgaaatgcgtagatatcgagaggaacacctgcggcgaaggcgggttgctgggccgacactgacgctgaagcgcgaaagctaggggagcgaacggg

SEQ ID NO: 53 - DNA, 253 bp, Unknown
  Description of Unknown: bacterium polynucleotide
  Chloracidobacteria
tacagagggggcaagcgttattcggaattattgggcgtaaagggcgcgtaggcggcttttcaagtcgggcgtgaaatctccgggcttaacccggaagggtcgttcgatactgttgagctagagtgtggaagaggcaactagaattccgtgtgtagcggtgaaatgcgtagatatacggaggaatacccgaggcgaaggcgggttgctgggccaacactgacgctgaggcgcgaaggccaggggagcaaacggg

SEQ ID NO: 54 - DNA, 254 bp, Unknown
  Description of Unknown: bacterium polynucleotide
  Chloracidobacteria
tacggggggagcaagcgttgttcggatttactgggcgtaaagggcacgtaggcggccaccgcaagtcggttgtgaaatctccgggcttaacccggaaaggtcaatcgatactgcggggctagagtgcagaaggggcaactggaattctcggtgtagcggtgaaatgcgtagatatcgagaggaacacctgcggcgaaggcgggttgctgggctgacactgacgctgaagcgcgaaagctaggggagcgaacggg

SEQ ID NO: 55 - DNA, 253 bp, Unknown
  Description of Unknown: bacterium polynucleotide
  Chloracidobacteria
tacgaggggagcaagcgttgttcggatttactgggcgtaaggggtgcgtaggcggcaccacaagtcacttgtgaaatctttgggcttaacccaaagcggccaagtgatactgtggagctagagtgcagaaggggcaactggaattcccggtgtagcggtgaaatgcgtagatatcggggggaacacctgcggcgaaggcgggttgctgggctgacactgacgctgaggcacgaaagctagggtagcaaacggg

SEQ ID NO: 56 - DNA, 253 bp, Unknown
  Description of Unknown: bacterium polynucleotide
  Chloracidobacteria; Ellin6075
tacgtagggagcaagcgttgttcggatttactgggcgtaaagggcgcgtaggcggcgcggtaagtcacttgtgaaatctctgagcttaactcagaacggccaagtgatactgcagtgctagagtgcagaaggggcaatcggaattcttggtgtagcggtgaaatgcgtagatatcaagaggaacacctgaggtgaagacgggttgctgggctgacactgacgctgaggcgcgaaagccaggggagcaaacggg

SEQ ID NO: 57 - DNA, 253 bp, Unknown
  Description of Unknown: bacterium polynucleotide
  Chloracidobacteria; Ellin6075
tacgtagggactaagcgttgttcggatttactgggcgtaaagggcgcgtaggcggcgtgacaagtcacttgtgaaatctccgggcttaactcggaacggtcatgtgatactgtcgtgctagagtgcagaaggggcaatcggaattcttggtgtagcggtgaaatgcgtagatatcaagaggaacacctgaggtgaagacgggttgctgggctgacactgacgctgaggcgcgaaagctaggggagcaaacggg

SEQ ID NO: 58 - DNA, 253 bp, Unknown
  Description of Unknown: bacterium polynucleotide
  Chloracidobacteria; Ellin6075
tacgtagggaccaagcgttgttcggatttactgggcgtaaagggcgcgtaggcggctttgtaagtcacttgtgaaatctccgggcttaactcggaacggccaagtgatactgcaatgctagagtgcggaaggggcaatcggaattcttggtgtagcggtgaaatgcgtagatatcaagaggaacacctgaggtgaagacgggttgctgggccgacactgacgctgatgcgcgaaagccaggggagcaaacggg

SEQ ID NO: 59 - DNA, 253 bp, Unknown
  Description of Unknown: bacterium polynucleotide
  Chloracidobacteria; Ellin6075
tacgtagggaccaagcgttgttcggatttactgggcgtaaagggcgcgtaggcggcgtgttaagtcagctgtgaaatctccgagcttaactcgggacggtcagctgatactgatgtgctagagtgcagaaggggcaatcggaattcttggtgtagcggtgaaatgcgtagatatcaagaggaacacctgaggtgaagacgggttgctgggctgacactgacgctgaggcgcgaaagccaggggagcaaacggg

SEQ ID NO: 60 - DNA, 253 bp, Unknown
  Description of Unknown: bacterium polynucleotide
  Chloracidobacteria; Ellin6075
tacgtagggaccaagcgttgttcggatttactgggcgtaaagggcgcgtaggcggcttaacaagtcacttgtgaaatctccgggcttaactcggaacggccaagtgaaactgtcaagctagagtgcagaaggggcaatcggaattcttggtgtagcggtgaaatgcgtagatatcaagaggaacacctgaggtgaagacgggttgctgggctgacactgacgctgaggcgcgaaagccaggggagcaaacggg

SEQ ID NO: 61 - DNA, 254 bp, Unknown
  Description of Unknown: bacterium polynucleotide
  Chloracidobacteria; Ellin6075
tacgtagggaccaagcgttgttcggatttactgggcgtaaagggcgcgtaggcggcaattcaagtcatctgtgaaatctccgggcttaacccggaacggtcaggtgatactgttttgctagagtgcggaaggggcaatcggaattctcggtgtagcggtgaaatgcgtagatatcgagaggaacaccagaggtgaagacgggttgctgggccgacactgacgctgacagcgcgaaagccaggggagcaaacggg

SEQ ID NO: 62 - DNA, 253 bp, Unknown
  Description of Unknown: bacterium polynucleotide
  Chloracidobacteria; Ellin6075
tacgtagggaccaagcgttgttcggatttactgggcgtaaagggcgcgtaggcggcgtggtaagtcacttgtgaaatctccgagcttaactcggaacggtcaagtgatactgctgtgctagagtgcagaaggggcaatcggaattcttggtgtagcggtgaaatgcgtagatatcaagaggaacacctgaggtgaagacgggttgctgggctgacactgacgctgaggcgcgaaagctagggtagcaaacggg

SEQ ID NO: 63 - DNA, 253 bp, Unknown
  Description of Unknown: bacterium polynucleotide
  Chloracidobacteria; Ellin6075
tacgtagggaccaagcgttgttcggatttactgggcgtaaagggcgcgtaggcggcaattcaagtcagttgtgaaatctccgagcttaactcggaacggtcaactgatactgttttgctagagtacagaaagggcaatcggaattcttggtgtagcggtgaaatgcgtagatatcaagaggaacacctgaggcgaaggcgggttgctaggctgatactgacgctgaggcgcgaaagctagggtagcaaacggg

SEQ ID NO: 64 - DNA, 254 bp, Unknown
  Description of Unknown: bacterium polynucleotide
  Chloracidobacteria; Ellin6075
tacgtagggagcaagcgttgttcggatttactgggcgtaaagggcgcgtaggcggcaaattaagtcagctgtgaaatctccgagcttaactcggaactgtcagctgatactgatctgctagagtgcggaaggggcaatcggaattcttggtgtagcggtgaaatgcgtagatatcaagaggaacacctgaggtgaagacgggttgctgggccgacactgacgctgagtgcgcgaaagccaggggagcaaacggg

SEQ ID NO: 65 - DNA, 253 bp, Unknown
  Description of Unknown: bacterium polynucleotide
  Chloracidobacteria; Ellin6075
tacgtagggaccaagcgttgttcggatttactgggcgtaaagggcgcgtaggcggcaattcaagtcagctgtgaaatctccgggcttaactcggaacggtcagctgatactgctttgctagagtgcagaaggggcaatcggaattcttggtgtagcggtgaaatgcgtagatatcaagaggaacacctgaggtgaagacgggttgctgggctgacactgacgctgaggcgcgaaagctagggtagcaaacggg

SEQ ID NO: 66 - DNA, 253 bp, Unknown
  Description of Unknown: bacterium polynucleotide
  Chloracidobacteria; Ellin6075
tacgtagggaccaagcgttgttcggatttactgggcgtaaagggcgcgtaggcggcgtgacaagtcacttgtgaaatctctgggcttaacccagaacggccaagtgaaactgttgtgctagagtgcagaaggggcaatcggaattctcggtgtagcggtgaaatgcgtagatatcgagaggaacaccagaggtgaagacgggttgctgggctgacactgacgctgaggcgcgaaagccaggggagcaaacggg

SEQ ID NO: 67 - DNA, 253 bp, Unknown
  Description of Unknown: bacterium polynucleotide
  Chloracidobacteria; Ellin6075
tacgtagggggcaagcgttgttcggatttactgggcgtaaagggcgcgtaggcggcatgacaagtcacttgtgaaatctccgggcttaactcggaacggccaagtgatactgttgagctagagtgcagaaggggcaatcggaattcttggtgtagcggtgaaatgcgtagatatcaaggggaacacctgaggtgaagacgggttgctgggctgacactgacgctgaggcgcgaaagctagggtagcaaacggg

SEQ ID NO: 68 - DNA, 253 bp, Unknown
  Description of Unknown: bacterium polynucleotide
  Chloracidobacteria; Ellin6075
tacgaagggggcaagcgttgttcggatttactgggcgtaaagggcgcgtaggcggcgtggtaagtcagctgtgaaatctccgagcttaactcggaacggtcagctgatactgctgtgctagagtacagaaagggcaatcggaattcttggtgtagcggtgaaatgcgtagatatcaaggggaacacctgaggcgaaggcgggttgctaggctgatactgacgctgaagcgcgaaagctagggtagcaaacggg

SEQ ID NO: 69 - DNA, 254 bp, Fimbriimonas sp.
  Fimbriimonadia; Fimbriimonadaceae; Fimbriimonas
gacgtagggtccaagcgttatccggatttactgggcgtaaagcgcgcgtaggcggtctgttaagtgcacaagtgaaagctccgggctcaactcggaaattgctttgcatactggcaggctggagggacgcagaggtctgtggaattcctggtgtaacggtgaaatgtgttgatatcaggaggaacacccatggcgaaggcagcagactgggcgtttcctgacgctgaggcgcgaaagcgtgggtagcaaacagg

SEQ ID NO: 70 - DNA, 253 bp, Fimbriimonas sp.
  Fimbriimonadia; Fimbriimonadaceae; Fimbriimonas
gacgtagggtccaagcgttgtccggatttactgggcgtaaagagcgcgtaggcggctcgttaagtgtagagtgaaatctctgggctcaccccagaaactgctctgcatactggcgagctggagggatggagaggcttgtggaattcctggtgtagcggtgaaatgcgttgatatcaggaggaacacccatggcgaaggcagcaagctggtcatcacctgacgctgaggcgcgaaagcgtgggtagcaaacagg

SEQ ID NO: 71 - DNA, 254 bp, Fimbriimonas sp.
  Fimbriimonadia; Fimbriimonadaceae; Fimbriimonas
gacgtagggtccaagcgttgtccggatttactgggcgtaaagagcgcgtaggcggcttgttaagtgtgaagtgaaatctccagggctcaacccggaaactgcttcgcatactggcaagcttgaggaatgcagaggtttgtggaattcctggtgtaacggtgaaatgtgttgatatcaggaggaacacccatggcgaaggcagcaaactgggcattatctgacgctgaggcgcgaaagcgtgggtagcaaacagg

SEQ ID NO: 72 - DNA, 253 bp, Fimbriimonas sp.
  Fimbriimonadia; Fimbriimonadaceae; Fimbriimonas
gacgtagggtccaagcgttgtccggatttactgggcgtaaagagcgcgtaggcggtccgttaagtgtagagtgaaagctccgggctcaacccggaaattgctctgcatactggcggactcgaggacggaagaggtttgtggaattcctggtgtagcggtgaaatgcgtagatatcaggaggaacacccatggcgaaggcagcaaactggtccgtatctgacgctgaggcgcgaaagcgtgggtagcaaacagg

SEQ ID NO: 73 - DNA, 253 bp, Fimbriimonas sp.
  Fimbriimonadia; Fimbriimonadaceae; Fimbriimonas
gacgtagggggcgagcgttgtccggatttactgggcgtaaagcgcgcgtaggcggtctgttaagtgtagagtgaaagctccgggctcaactcggaaattgctctgcatactggcaggctggagggacgcagaggtctgtggaattcctggtgtaacggtgaaatgtgttgatatcaggaggaacacccatggcgaaggcagcagactgggcgtttcctgacgctgaggcgccaaagcgtgggtagcaaacagg

SEQ ID NO: 74 - DNA, 254 bp, Fimbriimonas sp.
  Fimbriimonadia; Fimbriimonadaceae; Fimbriimonas
gacgtagggtccaagcgttgtccggatttactgggcgtaaagagcgcgtaggcggctcgttaagtgtgaagtgaaatctctagggctcaacccagaaattgctttacatactggcgagctagagggatgcagaggtttgtggaattcctggtgtagcggtgaaatgcgtagatatcaggaggaacacccatggcgaaggcagcaaactgggcatcatctgacgctgaggcgcgaaagcgtgggtagcaaacagg

SEQ ID NO: 75 - DNA, 254 bp, Fimbriimonas sp.
  Fimbriimonadia; Fimbriimonadaceae; Fimbriimonas
gacgtagggtgcaagcgttgtccggatttactgggcgtaaagagcgcgtaggcggtctgttaagtgtgaagtgaaatctccagagctcaactcggaaactgcttcgcatactggcaggctggaggaatggagaggtgagtggaattcctggtgtaccggtgaaatgggttgatatcaggaggaacaccgatggcgaaggcagctcactggccattatctgacgctgaggcgcgaaagcgtgggtagcaaacagg

SEQ ID NO: 76 - DNA, 253 bp, Fimbriimonas sp.
  Fimbriimonadia; Fimbriimonadaceae; Fimbriimonas
gacgtagggtccaagcgttgtccggatttactgggcgtaaagagcgcgtaggcggtctgttaagtgtagagtgaaagctccgggctcaactcggaaattgctctgcatactggcagacttgaggatggaagaggtttgtggaattcctggtgcagaggtgaaatgcgtagatatcaggaggaacacccatggcgaaggcagcaaactggtccatatctgacgctgaggcgcgaaagcgtgggtagcaaacagg

SEQ ID NO: 77 - DNA, 253 bp, Turneriella sp.
  Leptospirae; Leptospiraceae; Turneriella
tacgtatggggcaagcgttgttcggaattattgggcgtaaagggctcgcaggtggtttgttaagttggtggtttaatctctgggctcaacccagagtcagcctccaaaactggcgaacttgagtacgataggggatagcggaattctcggtgtagcggtggaatgcgtagatatcgagaggaacaccaatggcgaaggcagctatctggatcgtaactgacactcatgagcgaaagtgcggggagcaaacagg

SEQ ID NO: 78 - DNA, 253 bp, Unknown
  Description of Unknown: bacterium polynucleotide
  Methylacidiphilae
gacagaggtcccgagcgttgttcggattcattgggcgtaaagggtgtgtaggaggtcgggtaagtcaggtgtgaaatctcagagcttaactctgaaactgcgcttgatactgctcggctagaggatcggagggggtaacggaatttatggtgtagcagtgaaatgcgtagatatcataaggaacaccggtggcgaaggcggttacctggaagattcctgactctgaaacacgaaagccaggggagcaaacggg

SEQ ID NO: 79 - DNA, 253 bp, Unknown
  Description of Unknown: bacterium polynucleotide
  Methylacidiphilae
tacagagactgcaagcgttgttcggattcattgggcgtaaagggtccgtaggcggtcggttaagtcggatgtgaaatctcgtggcccaaccacgagcggtcattcgaaactaatcggctagagggctggagaggagactggaattgtcggtgtagcggtgaaatgcgtagagatcgacaagaacaccggtggcgaaggcgggtctctggacagttcctgacgctgagggacgaaagctaggggagcaaacggg

SEQ ID NO: 80 - DNA, 253 bp, Unknown
  Description of Unknown: bacterium polynucleotide
  Pedosphaerae
tacagaggtcccaagcgttgttcggattcactgggcgtaaagggtgcgtaggtggtcgggtaagtctgatgtgaaatctccgagcctaactcggaaactgcatcggatactattcggcttgagggttggaggggggactggaatacttggtgtagcagtgaaatgcgtagatatcaagtggaacaccagtggcgaaggcgagtccctggacaactcctgacactgaggtacgaaagcgtggggagcaaacagg

SEQ ID NO: 81 - DNA, 253 bp, Unknown
  Description of Unknown: bacterium polynucleotide
  Pedosphaerae
tacagaggtcccaagcgttgttcggattcactgggcgtaaagggtgcgtaggtggcggggtaagtttgatgtgaaatctccgggcttaacccggaaatggcattgaatactatcttgctcgagggttggaggggagactggaattctcggtgtagcagtgaagtgcgtagatatcgagaggaacaccagtggcgaaggcgagtctctggacaactcctgacactgaggcacgaaagctaggggagcaaacagg

SEQ ID NO: 82 - DNA, 253 bp, Unknown
  Description of Unknown: bacterium polynucleotide
  Pedosphaerae
tacagaggtcccaagcgttgttcggattcactgggcgtaaagggtgcgtaggtggttctgcaagtctgatgtgaaatctccgggcttaacccggaaatggcattggaaactgcagggctagagtgttggaggggggactggaattctcggtgtagcagtgaaatgcgtagatatcgagaggaacaccagtggcgaaggcgagtccctggacaactactgacactgaggcacgaaagctaggggagcaaacagg

SEQ ID NO: 83 - DNA, 253 bp, Unknown
  Description of Unknown: bacterium polynucleotide
  Pedosphaerae
tacagaggtcccaagcgttgttcggatttactgggcgtaaagggcgcgtaggtggcaaaaaaagtctggtgtgaaatctccgagcttaactcggaaactgcactagaaactgttttgctagagtgttggaggggagattggaattctcggtgtagcagtgaaatgcgtagatatcgagaggaacaccagtggcgaaggcgaatctctggacaactactgacgctgatgcgcgaaagctaggggatcaaacggg

SEQ ID NO: 84 - DNA, 253 bp, Unknown
  Description of Unknown: bacterium polynucleotide
  Pedosphaerae
tacagaggtctcaagcgttgttcggattcactgggcgtaaagggtgcgtaggtggccgggtaagtttgatgtgaaatctccgagcttaactcggaaattgcattgaatactatccggctagaggattggaggggaaactggaattctcggtgtagcagtgaaatgcgtagatatcgagaggaacaccagtggcgaaggcgagtttctggacaattcctgacactgaggcacgaaagctaggggagcaaacagg

SEQ ID NO: 85 - DNA, 253 bp, Unknown
  Description of Unknown: bacterium polynucleotide
  Pedosphaerae
tacagaggtcccaagcgttgatcggattcactgggcgtaaagggtgcgtaggcggtcggataagtctgatgtgaaatctctgggcttaacccagaaatggcattggatactattcggctagagagttggaggggggactggaattcttggtgtagcagtgaaatgcgtagatatcaagaggaacaccagtggcgaaggcgagtccctggacaacttctgacgctgaggcacgaaagctaggggagcaaacagg

SEQ ID NO: 86 - DNA, 253 bp, Unknown
  Description of Unknown: bacterium polynucleotide
  Pedosphaerae
tacagaggtcccaagcgttgttcggattcactgggcgtaaagggtgcgtaggcggtcgggtaagtctgatgtgaaatctcacagcttaactgtgaaactgcattggatactattcggctagagagttggaggggggactggaattcttggtgtagcagtgaaatgcgtagatatcaagaggaacaccagtggcgaaggcgagtccctggacaacttctgacgctgaggcacgaaagctaggggagcaaacagg

SEQ ID NO: 87 - DNA, 253 bp, Unknown
  Description of Unknown: bacterium polynucleotide
  Pedosphaerae
tacagaggtcccaagcgttgttcggatttactgggcgtaaagggcgcgtaggtggtaggctaagtctggtgtgaaatctctgagcttaactcagaaatggcactagatactagcttgcttgagggttggaggggagactggaattctcggtgtagcagtgaaatgcgtagatatcgagaggaacaccagtggcgaaggcgagtctctggacaactcctgacactgaggcgcgaaagctaggggagcaaacggg

SEQ ID NO: 88 - DNA, 253 bp, Unknown
  Description of Unknown: bacterium polynucleotide
  Pedosphaerae
tacagaggtcccaagcgttgttcggattcactgggcgtaaagggtgcgtaggtggtgaggtaagtcggatgtgaaatctccaagctcaacttggaaactgcattggaaactaccttgctagaggatttgaggggggattggaatacttggtgtagcagtgaaatgcgtagatatcaagtggaacaccagtggcgaaggcgaatccctggaaaatacctgacactgaggcacgaaagctaggggagcaaacagg

SEQ ID NO: 89 - DNA, 253 bp, Unknown
  Description of Unknown: bacterium polynucleotide
  Pedosphaerae
tacagaggtcccaagcgttgttcggattcactgggcgtaaagggtgcgcaggtggccaggtaagtctgatgtgaaatctcgaagcttaacttcgaaactgcattggatactatctggctggagggtcggaggggggactggaattctcggtgtagcagtgaaatgcgtagatatcgagaggaacaccagtggcgaaggcgagtccctggacgactcctgacactgaggcacgaaagctaggggagcaaacagg

SEQ ID NO: 90 - DNA, 253 bp, Unknown
  Description of Unknown: bacterium polynucleotide
  Pedosphaerae
tacagaggtcccgagcgttgttcggattcactgggcgtaaagggtgcgtaggtggtgaggtaagtcggatgtgaaatctccaggctcaacctggaaactgcattggaaactaccttgcttgagggtttgaggggggactggaattctcggtgtagcagtgaaatgcgtagatatcgagaggaacaccggtggcgaaggcgagtccctggaaaacacctgacactgaggcacgaaagctaggggagcaaacagg

SEQ ID NO: 91 - DNA, 253 bp, Unknown
  Description of Unknown: bacterium polynucleotide
  Pedosphaerae
tacagaggtcccaagcgttgttcggattcactgggcgtaaagggtgcgtaggtggtcgggtaagtctgatgtgaaatctccgagcttaactcggaaatggcattggatactattcggctagagggtttgaggggggactggaatacttggtgtagcagtgaaatgcgtagatatcaagtggaacaccagtggcgaaggcgagtccctggaaaactcctgacactgaggcacgaaagctaggggagcaaacagg

SEQ ID NO: 92 - DNA, 253 bp, Unknown
  Description of Unknown: bacterium polynucleotide
  Pedosphaerae
tacagaggtcccaagcgttgttcggattcactgggcgtaaagggtgcgtaggtggtgaggtaagtcggatgtgaaatctccgggctcaacccggaaatggcattggaaactaccttgctggagggtttgaggggggattggaatacttggtgtagcagtgaaatgcgtagatatcaagtggaacaccagtggcgaaggcgaatccctggaaaatacctgacactgaggcacgaaagctaggggagcaaacagg

SEQ ID NO: 93 - DNA, 253 bp, Unknown
  Description of Unknown: bacterium polynucleotide
  Pedosphaerae
tacagaggtcccaagcgttgttcggattcactgggcgtaaagggtgtgtaggcggtcgagtaagtttgttgtgaaatctccaagctcaacttggaaaatgcaatgaaaactgcttggctagaggattgtagggggggctggaattctcggtgtagcagtgaaatgcgtagatatcgagaggaacaccagtggcgaaggcgagtccctggacaaatcctgacgctgaggcacggaagctgggggagcaaacagg

SEQ ID NO: 94 - DNA, 253 bp, Unknown
  Description of Unknown: bacterium polynucleotide
  Pedosphaerae
tacagaggtcccgagcgttgttcggattcactgggcgtaaagggtgcgtaggcggtggagtaagtctggtgtgaaagctcggagctcaactccgaaatgtcatcggaaactacttcacttgaggtttggaggggggactggaattctcggtgtagcagtgaaatgcgtagatatcgagaggaacaccagtggcgaaggcgagtccctggacaaatcctgacgctgaggcacgaaagctaggggagcaaacagg

SEQ ID NO: 95 - DNA, 253 bp, Unknown
  Description of Unknown: bacterium polynucleotide
  Pedosphaerae
tacagaggtcccaagcgttgttcggatttactgggcgtaaagggagcgtaggtggcattctaagtctgatgtgaaagctctgagcttaactcagaaatggcattagatactagtttgcttgaggattggaggggagattggaatacttggtgtagcagtgaaatgcgtagatatcgagtggaacaccagtggcgaaggcgaatctctggacaattcctgacactgatgctcgaaagctaggggagcaaacggg

SEQ ID NO: 96 - DNA, 253 bp, Unknown
  Description of Unknown: bacterium polynucleotide
  Pedosphaerae
tacagaggtcccaagcgttgttcggatttactgggcgtaaagggagcgtaggtggcagattaagtctgacgtgaaagctctgagcttaactcagaaatggcgttagatactagtttgcttgaggattggaggggagattggaattctcggtgtagcagtgaaatgcgtagatatcgagaggaacaccagtggcgaaggcgaatctctggacaattcctgacactgatgctcgaaagctaggggagcaaacggg

SEQ ID NO: 97 - DNA, 253 bp, Unknown
  Description of Unknown: bacterium polynucleotide
  Pedosphaerae
tacagaggtcccaagcgttgttcggattcactgggcgtaaagggtgcgtaggtggtggggtaagtttgatgtgaaagctccgggcctaacccggaaatggcattgaatactatctcgcttgagggttggaggggagactggaattcttggtgtagcagtgaaatgcgtagatatcaagaggaacaccagtggcgaaggcgagtctctggacaactcctgacactgaggcacgaaagctaggggagcaaacagg

SEQ ID NO: 98 - DNA, 252 bp, Unknown
  Description of Unknown: bacterium polynucleotide
  Pedosphaerae
tacagaggtcccaagcgttgttcggattcactgggcgtaaagggtgcgtaggcggtcgggtaagtctgatgtgaaatctcacagcttaactgtgaaactgcattggatactattcggcttgaggtctggagggggactggaattctcggtgtagcagtgaaatgcgtagatatcgagaggaacaccagtggcgaaggcgagtctctgggccgatattgacgctgaggagcgaaagcgtgggaagcgaacagg

SEQ ID NO: 99 - DNA, 253 bp, Unknown
  Description of Unknown: bacterium polynucleotide
  Pedosphaerae
tacagagggggcaagcgttgttcggattcactgggcgtaaagggtgcgtaggcggtcgggtaagtctgatgtgaaatctcagagctcaactctgaaactgcattggatactattcggcttgaggtctggaggggggactggaattctcggtgtagcagtgaaatgcgtagatatcgagaggaacaccagtggcgaaggcgagtccctggacaggtcctgacgctgaggcacgaaagctaggggagcaaacagg

SEQ ID NO: 100 - DNA, 253 bp, Unknown
  Description of Unknown: bacterium polynucleotide
  Pedosphaerae
tacagaggtcccaagcgttgttcggattcactgggcgtaaagggtgcgtaggtggccgggtaagttcgatgtgaaagctcggagctcaactccgaaatggcattgaatactatccggctggagggtcggaggggagactggaattctcggtgtagcagtgaaatgcgtagatatcgagaggaacaccagtggcgaaggcgactacctggcccattcttgacgctgaggcgcgaaagctaggggagcgaacggg

SEQ ID NO: 101 - DNA, 253 bp, Unknown
  Description of Unknown: bacterium polynucleotide
  Pedosphaerae; Pedosphaeraceae
tacagaggtcccaagcgttgttcggattcactgggcgtaaagggtgcgtgggcggtggaataagtctgatgtgaaagctctgggcctaacccagaaattgcattggaaactatttcactagagtctctaaggggaggctggaattctcggtgtagcagtgaaatgcgtagatatcgagaggaacaccagtagcgaaagcgagcctctgggagagaactgacgctgaggcacgaaagctaggggatcaaacagg

SEQ ID NO: 102 - DNA, 253 bp, Unknown
  Description of Unknown: bacterium polynucleotide
  Pedosphaerae; auto67_4W
tacagaggtcccaagcgttgttcggattcactgggcgtaaagggtgcgtaggcggtcgggtaagtctgacgtgaaatcttcaagctcaacttggaaactgcgtcggatactattcggctcgaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 103 - DNA, 253 bp, Unknown
  Description of Unknown: bacterium polynucleotide
  Pedosphaerae; auto67_4W
tacagaggtcccaagcgttgttcggattcactgggcgtaaagggtgcgtaggcggtcgggtaagtctggcgtgaaatctccgagcctaactcggaaactgcgctggatactatccggcttgaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 104 - DNA, 253 bp, Unknown
  Description of Unknown: bacterium polynucleotide
  Pedosphaerae; auto67_4W
tacggaggattcgagcgttatccggatttattgggtttaaagggcgcgtaggcggttgaataagtttggcgtgaaatctccgggcctaacccggaaactgcgttggatactgttcagctagaggaatggaggggagactggaatacttggtgtagctgtgaaatgcgtagatatcaagtggaacaccagtggcgaaggcgagtctctggacatttcctgacgctgaggcacgaaagccaggggagcaaacggg

SEQ ID NO: 105 - DNA, 253 bp, Unknown
  Description of Unknown: bacterium polynucleotide
  Pedosphaerae; auto67_4W
tacagaggtcccaagcgttgttcggattcactgggcgtaaagggtgcgtaggtggttgggtaagtctgacgtgaaatctccgggcctaacccggaaactgcgtcggatactatccaactcgaggaatggaggggagactggaatacttggtgtagcagtgaaatgcgtagatatcaagtggaacaccagtggcgaaggcgagtctctggacatttcctgacactgaggcacggaagccaggggagcaaacggg

SEQ ID NO: 106 - DNA, 253 bp, Unknown
  Description of Unknown: bacterium polynucleotide
  Pedosphaerae; auto67_4W
tacagaggtcccaagcgttgttcggatttactgggcgtaaagggtgcgtaggcggttgtttaagtctgacgtgaaatctccgggcctaacccggaaactgcgttggatactattcaactagaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 107 - DNA, 253 bp, Unknown
  Description of Unknown: bacterium polynucleotide
  Pedosphaerae; auto67_4W
tacagaggtcccaagcgttgttcggattcactgggcgtaaagggtgcgtaggcggtttgacaagtctgatgtgaaatcccgcagcttaactgcggaactgcattggaaactgtctgactagaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 108 - DNA, 253 bp, Unknown
  Description of Unknown: bacterium polynucleotide
  Pedosphaerae; auto67_4W
tacagaggtcccaagcgttgttcggattcactgggcgtaaagggtgcgtaggcggctgggtaagtttgacgtgaaatctccgggcttaacccggaaactgcgttgaatactatccagctagaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 109 - DNA, 253 bp, Unknown
  Description of Unknown: bacterium polynucleotide
  Pedosphaerae; Ellin515
tacagaggtcccgagcgttgttcggattcactgggcgtaaagggtgcgtaggtggtaaggtaagtcggatgtgaaatctccgagctcaactcggaaatggcattggaaactaccttgctcgagggttggaggggggactggaatacttggtgtagcagtgaaatgcgtagatatcaagtggaacaccagtggcgaaggcgagtccctggacaactcctgacactgaggcacgaaagctaggggagcaaacagg

SEQ ID NO: 110 - DNA, 253 bp, Unknown
  Description of Unknown: bacterium polynucleotide
  Pedosphaerae; Ellin515
tacagaggtcccaagcgttgttcggatttactgggcgtaaagggtgcgtaggtggcggggtaagtcggatgtgaaatctccaggctcaacctggaaatggcattggaaactaccttgctggagagttggaggggggactggaatacttggtgtagcagtgaaatgcgtagatatcaagtggaacaccagtggcgaaggcgagtccctggacaacttctgacgctgaggcacgaaagctaggggagcaaacagg

SEQ ID NO: 111 - DNA, 253 bp, Unknown
  Description of Unknown: bacterium polynucleotide
  Pedosphaerae; Ellin517
tacagaggtcccgagcgttgttcggattcactgggcgtaaagggtgcgtaggtggcatgttaagtttgatgtgaaagctcagggctcaaccctgaaatggcattgaatactagcgtgctggaggtttggaggggggactggaattctcggtgtagcagtgaaatgcgtagatatcgagaggaacaccagtggcgaaggcgagtccctggacaacacctgacactgaggcacgaaagctaggggagcaaacagg

SEQ ID NO: 112 - DNA, 253 bp, Unknown
  Description of Unknown: bacterium polynucleotide
  Pedosphaerae; Ellin517
tacagaggtcccaagcgttgttcggattcactgggcgtaaagggtgcgcaggtgggctggcaagtttgatgtgaaagccccgggcttaacccgggaatggcattgaatactgctgatctggaggattggaggggggactggaattcttggtgtagcagtgaaatgcgcagatatcaagaggaacaccagtggcgaaggcgagtccctggacaatacctgacactgaggcacgaaagccgggggagcaaacagg

SEQ ID NO: 113 - DNA, 253 bp, Unknown
  Description of Unknown: bacterium polynucleotide
  Pedosphaerae; Ellin517
tacggagggtgcaagcgttatccggattcactgggtgtaaagggtgcgtaggtggcttggtaagtttgatgtgaaatctccgggcttaacccggaaatggcattgaatactattgagctggaggtttggaggggggactggaattctcggtgtagcagtgaaatgcgtagatatcgagaggaacaccagtggcgaaggcgagtccctggacaacacctgacactgaggcacgaaagctaggggagcaaacagg

SEQ ID NO: 114 - DNA, 253 bp, Unknown
  Description of Unknown: bacterium polynucleotide
  Pedosphaerae; Ellin517
tacagaggtcccgagcgttgttcggattcactgggcgtaaagggtgcgtaggtggcaatgtaagtttgatgtgaaagctcagggcttaaccctgaaatggcattgaatactacatggctggaggtttggaggggggactggaattcttggtgtagcagtgaaatgcgtagatatcaagaggaacaccagtggcgaaggcgagtccctggacaacacctgacactgaggcacgaaagccgggggagcaaacagg

SEQ ID NO: 115 - DNA, 253 bp, Unknown
  Description of Unknown: bacterium polynucleotide
  Pedosphaerae; Ellin517
tacagaggtcccaagcgttgttcggattcactgggcgtaaagggtgcgtaggtggcgtggtaagtttgatgtggaagctcagggcttaaccctgaaatggcattgaatactactgtgctggaggtttggaggggggactggaattcttggtgtagcagtgaaatgcgtagatatcaagaggaacaccagtggcgaaggcgagtccctggacaacacctgacactgaggcacgaaagccgggggagcaaacagg

SEQ ID NO: 116 - DNA, 253 bp, Unknown
  Description of Unknown: bacterium polynucleotide
  Pedosphaerae; Ellin517
tacagaggtcccaagcgttgttcggattcactgggcgtaaagggtgcgcaggtgggttggtaagttcgatgtgaaagccctgggcttaacccgggaatggcattggatactactgatctggagggttggaggggggactggaattcttggtgtagcagtgaaatgcgtagatatcaagaggaacaccagtggcgaaggcgagtccctggacaaaccctgacactgaggcacgaaagccaagggagcaaacagg

SEQ ID NO: 117 - DNA, 253 bp, Unknown
  Description of Unknown: bacterium polynucleotide
  Pedosphaerae; Ellin517
tacagaggtcccaagcgttgttcggattcactgggcgtaaagggtgcgcaggtgggctgtcaagttcgatgtgaaagccccgggcttaacccgggaatggcattgaatactgatggtctggaggatcggaggggggactggaattcttggtgtagcagtgaaatgcgtagatatcaagaggaacaccagtggcgaaggcgagtccctggacgatacctgacactgaggcacgaaagccaagggagcaaacggg

SEQ ID NO: 118 - DNA, 253 bp, Unknown
  Description of Unknown: bacterium polynucleotide
  Pedosphaerae; Ellin517
tacagaggtcccaagcgttgttcggattcactgggcgtaaagggtgcgtaggtggcttgaaaagtttgatgtgaaagctcagggctcaaccctgaaatggcattgaataccgtcgggctggaggtttggaggggggactggaattctcggtgtagcagtgaaatgcgtagatatcgagaggaacaccagtggcgaaggcgagtccctggacaacacctgacactgaggcacgaaagccgggggagcaaacagg

SEQ ID NO: 119 - DNA, 252 bp, Unknown
  Description of Unknown: bacterium polynucleotide
  Pedosphaerae; Ellin517
tacgaggtcccaagcgttgttcggattcactgggcgtaaagggtgcgcaggtgggtttgcaagttcgatgtgaaagccccgggcttaacccgggaatggcattggatactgcagatctggaggatcggaggggggactggaattcttggtgtagcagtgaagtgcgtagatatcgagaggaacaccagtggcgaaggcgagtccctggacaacacctgacactgaggcacgaaagctaggggagcaaacagg

SEQ ID NO: 120 - DNA, 253 bp, Unknown
  Description of Unknown: bacterium polynucleotide
  Pedosphaerae; OPB35
tacagaggtcccaagcgttgttcggatttactgggcgtaaagggtgcgtaggtggtcgggtaagtctcatgtgaaatctccaagcttaacttggaaatggcatgggatactattcggctagaggattggaggggggactggaattcccggtgtagcagtgaaatgcgtagatatcgggaggaacaccagtggcgaaggcgagtccctggacaattcctgacgctgaggcacgaaagctaggggagcaaacagg

SEQ ID NO: 121 - DNA, 253 bp, Unknown
  Description of Unknown: bacterium polynucleotide
  Pedosphaerae; R4-41B
tacagaggtcccaagcgttgttcggatttactgggcgtaaagggtgcgtaggcggttggataagtgtgaagtgaaagctccaagcttaacttggaaaatgcttcatatactatctgactagagggccggaggggagattggaactctcggtgtagcagtgaaatgcgtagatatcgagaggaacaccagtggcgaaagcgaatctctggacggcatctgacgctgaggcacgaaagccaaggtagcaaacggg

SEQ ID NO: 122 - DNA, 253 bp, Unknown
  Description of Unknown: bacterium polynucleotide
  Pedosphaerae; R4-41B
tacagaggtcccaagcgttgttcggattcactgggcgtaaagggtgcgtaggtggtcggttaagtttgaggtgaaagctccgggctcaacccggaaaatgcctcgaagactatctgactaggggattggaggggagactggaattctcggtgtagcagtgaaatgcgtagatatcgagaggaacaccagtggcgaaggcgagtctctggacaattcctgacactgaggcacgaaagccaagggagcaaacggg

SEQ ID NO: 123 - DNA, 253 bp, Unknown
  Description of Unknown: bacterium polynucleotide
  Pedosphaerae; R4-41B
tacgtaggtggcaagcgttatccggatttactgggcgtaaagggtgcgtaggcggcatggaaagttcggggtgaaatctccaggctcaacttggaaactgccttgaatacttccttgcttgagggtcgcagaggagattggaattctcggtgtagcagtgaaatgcgtagatatcgagaggaacatcagtggcgaaagcgaatctctaggcgacatctgacgctgaggcacgaaagccaggggagcaaacagg

SEQ ID NO: 124 - DNA, 253 bp, Rubricoccus sp.
  Rhodothermi; Rhodothermaceae; Rubricoccus
tacggagggtccaagcgttgtccggaatcactgggtgtaaagggtgcgtaggcggactcgtaagtcagaggtgaaagcccgcggctcaaccgcggaactgcctttgatactgcgagccttgagtcctggaggggttggcggaattcgtggtgtagcggtgaaatgcgtagatatcacgaggaacaccggaggtgtagacggccaactggacaggtactgacgctgaggcacgaaagcgtggggagcgaacagg

SEQ ID NO: 125 - DNA, 253 bp, Unknown
  Description of Unknown: bacterium polynucleotide
  Saprospirae
tacggagggtgcaagcgttatccggattcactgggtttaaagggagcgtaggtggctttgtaagtcagtggtgaaatgccgcagcttaactgcggaactgccattgatactgcttagcttgaatcacgtcgaggtggatggaatattacatgtagcggtgaaatgcttagatatgtaatagaacaccgattgcgaaggcagttcactaggcgtgtattgacactgaggctcgaaagcgtggggatcaaacagg

SEQ ID NO: 126 - DNA, 253 bp, Unknown
  Description of Unknown: bacterium polynucleotide
  Saprospirae
tacggagggtgcaagcgttatccggatttactgggtttaaagggtgcgtaggcgggaaaataagtcagtggtgaaagctccgggctcaactcgggaactgccattgatactgtttttcttgaatgcgattgaggtaagcggaatgttgcatgtagcggtgaaatgcttagatatgttacagaacaccaattgtgaagacagcttactaagtcgtgattgacgctgaggcacgaaagcgtggggagcaaacagg

SEQ ID NO: 127 - DNA, 253 bp, Unknown
  Description of Unknown: bacterium polynucleotide
  Saprospirae
tacggagggtgcaagcgttatccggattcactgggtttaaagggtgcgtaggcgggcttgtaagtcagtggtgaaagcccggagcttaactccggaactgccattgatactgcaggtcttgagtacacttgaggtgggcggaatacatcatgtagtggtgaaatacttagatatgatgtagaacaccgattgcgaaggcagctcactaaattgtaactgacgctgaggcacgaaagcgtggggatcaaacagg

SEQ ID NO: 128 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggcaggtaagtcagtggtggaatccccgagcttaacttgggaactgccgttgatactatctgtcttgaatatcgtggaggttagcggaatatgtcatgtagcggtgaaatgcttagagatgacatagaacaccaattgcgaaggcagctggctacacggtaattgacactgaggcacgaaggcgtggggagcaaacagg

SEQ ID NO: 129 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggcaggtaagtcagtggtgaaatctccgggcttaacccggaaactgccattgatactatctgtcttgaataccgtggaggtgagcggaatatgtcatgtagcggtgaaatgcttagatatgacatagaacaccaattgcgaaggcagctcactacgcgaatattgacactgaggcacgaaagcgtggggatcaaaaagg

SEQ ID NO: 130 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggtctgtaagtcagtggtgaaatccccgagcttaacttgagaactgccattgatactatagctcttgaatactgtggaggtcagcggaatatgtcatgtagcggtgaaatgcttagatatgacatagaacaccaattgcgaaggcagctggctacacaaatattgacactgaggcacgaaagcgtggggatcaaacagg

SEQ ID NO: 131 - DNA, 252 bp, Unknown
  Description of Unknown: bacterium polynucleotide
  Saprospirae; Chitinophagaceae
tacggagggtgcaagcgttatccggattcactgggttaaagggtgcgtaggtgggcaggtaagtcagtggtgaaatctccgggcttaacccggaaactgccgttgatactatctgtcttgaatatcgtggagatgagcggaatatgtcatgtagcggtgaaatgcttagatatgacatagaacaccaattgcggaggcagctcgctacacggttattgacactgaggcacgaaagcgtggggatcaaacagg

SEQ ID NO: 132 - DNA, 253 bp, Unknown
  Description of Unknown: bacterium polynucleotide
  Saprospirae; Chitinophagaceae
tacggaggttgcaagcgttatccggatttactgggtttaaagggtgtgtaggcggatatttaagtcagaggtgaaatctccgagctcaactcggaaactgcctttgatactatttatcttgaatttcgttgaggttggcagaatatatcatgtagcggtgaaatgcatagatatgatatagaataccgattgcgtaggcagctggctgaacgacgattgacgctgaggcacgaaagcgtgggtagcgaacagg

SEQ ID NO: 133 - DNA, 253 bp, Unknown
  Description of Unknown: bacterium polynucleotide
  Saprospirae; Chitinophagaceae
tacggagggtgcaagcgttatccggatttactgggtttaaagggtgcgtaggcggacttgtaagtctgaggtgaaatctccgagcttaactcggaaactgccttggatactataggtcttgaatgtcgttgaggtcagcggaatatgtcatgtagcggtgaaatgcttagatatgacatagaacacctattgcgaaggcagctggctaagcgaaaattgacgctgatgcacgaaagcgtggggatcaaacagg

SEQ ID NO: 134 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggctagtaagtccgtggtgaaatctccaagcttaacttggaaactgccgtggatactattagtcttgaatattgtggaggtaagcggaatatgtcatgtagcggtgaaatgcttagatatgacatagaacaccgatagcgaaggcagcttgctacacaatcattgacactgaggcacgaaagcgtggggatcaaacagg

SEQ ID NO: 135 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggttggtaagtcagtggtgaaatctccgagcttaacttggaaactgccgttgatactatcaatcttgaatatcgcgtaggtaagcggaatatgtcatgtagcggtgaaatgcttagatatgacatagaacaccaattgcgaaggcagcttacttcacgatcattgacactgaggcacgaaagcgtggggagcaaacagg

SEQ ID NO: 136 - DNA, 253 bp, Unknown
  Description of Unknown: bacterium polynucleotide
  Saprospirae; Chitinophagaceae
tacggagggtgcaagcgttatccggattcgctgggtttaaagggtgcgtaggcgggcatttaagtcagtggtgaaatacctgagcttaacttgggaactgccattgatactatttgtcttgaatgtcgtggaggttagcggaatatgtcatgtagcggtgaaatgcttagatatgacatagaacacctattgcgaaggcagctaactacgcgaatattgacgctgaggcacgaaagcgtggggatcaaacagg

SEQ ID NO: 137 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggttggtaagtcagtggtgaaatccccgagcttaacttgggaactgccattgatactatcagtcttgaataccgtggaggttagcggaatatgtcatgtagcggtgaaatgcttagatatgacatagaacaccaattgcgaaggcagctggctacacgaatattgacactgaggcacgaaagcgtggggatcaaacagg

SEQ ID NO: 138 - DNA, 253 bp, Unknown
  Description of Unknown: bacterium polynucleotide
  Saprospirae; Chitinophagaceae
tacggagggtgcaagcgttatccggatttactgggtttgaagggtgtgtaggcgggctattaagtcagtggtgaaatctccgagcttaacttggaaactgccattgatactattagtcttgaattctgttgaggtgggcggaataagtcatgtagcggtgaaatgcatagatatgacttagaacaccaattgcgaaggcagctcgctaaacagatattgacgctgaggcacgaaagcgtggggatcaaacagg

SEQ ID NO: 139 - DNA, 253 bp, Unknown
  Description of Unknown: bacterium polynucleotide
  Saprospirae; Chitinophagaceae
tacggagggtgcaagcgttatccggatttactgggtttaaagggtgcgtaggtgggtaggtaagtcagtggtgaaatcttcaagcttaacttggaaactgccattgatactatttatcttgaatactttggaggtaagcggaatatgtcatgtagcggtgaaatgcttagatatgacatagaacaccaattgcgaaggcagcttactacacagttattgacactgaggcacgaaagcgtggggatcaaacagg

SEQ ID NO: 140 - DNA, 253 bp, Unknown
  Description of Unknown: bacterium polynucleotide
  Saprospirae; Chitinophagaceae
tacggagggtgcaagcgttatccggatttactgggtttaaagggtgcgtaggtgggttggtaagtcagtggtgaaatctccgggcttaactcggaaactgccattgatactatcaatcttgaatcatctggaggtaagcggaatatgtcatgtagcggtgaaatgcttagatatgacatagaacacccattgcgaaggcagcttactacgggtgcattgacactgaggcacgaaagcgtggggatcaaacagg

SEQ ID NO: 141 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggcagttaagtcagtggtgaaatctccaggctcaacctggaaactgccattgatactatctgtcttgaattctgttgaggtgggcggaatacatcatgtagcggtgaaatgcttaggtatgatgtagaacaccgattgcgaaggcagctcactaagcagcgattgacgctgaggcacgaaagcgtggggatcaaacagg

SEQ ID NO: 142 - DNA, 253 bp, Unknown
  Description of Unknown: bacterium polynucleotide
  Saprospirae; Chitinophagaceae
tacggagggtgcaggcgttatccggattcactgggtttaaagggtgcgtaggcgggcaggtaagtcagtggtgaaatctttgggcttaacccgaaaactgccattgatactatctgtcttgaatattgtggaggtttgcggaatatgtcatgtagcggtgaaatgcttagatatgacatagaacacctattgcgaaggcagcaaactacgcatatattgacgctgaggcacgaaagcgtggggatcaaacagg

SEQ ID NO: 143 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggttggtaagtcagtggtgaaatctccgagcttaacttggaaactgccattgatactattaatcttgaataccgtggaggtcggcggaatatgtcatgtagcggtgaagtgcttagatatgacatagaacaccaattgcgaaggcagctggctacacgagtattgacactgaggcacgaaagcgtggggatcaaacagg

SEQ ID NO: 144 - DNA, 253 bp, Unknown
  Description of Unknown: bacterium polynucleotide
  Saprospirae; Chitinophagaceae
tacggagggtgcaagcgttatccggatttactgggtttaaagggtgcgcaggcggatatgtaagtcagtggtgaaatctctaggcttaacctggaaattgccgttgatactatatatcttgaatgctgtggaggtaagcagaatatgtcatgtagcggtgaaatgcttagatatgacatagaatacctattgcgaaggcagcttactacgcagatattgacgctcatgcacgaaagcgtggggatcaaacagg

SEQ ID NO: 145 - DNA, 253 bp, Unknown
  Description of Unknown: bacterium polynucleotide
  Saprospirae; Chitinophagaceae
tacggagggtgcaagcgttatccggattcactgggtttaaagggtgcgtaggagggcaggtaagtcagtggtgaaatccccgagcttaacttgggaactgccgttgatactatctgtcttgaatattgtggaggtaagcggaatatgtcatgtagcggtgaaatgcttagatatgacatagaacaccaattgcgaaggcagcttgctacacaactattgactctgatgcacgaaagcgtggggatcaaacagg

SEQ ID NO: 146 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggctgttaagtcagaggtgaaatctccaggctcaacctggaaactgcctttgatactatcagtcttgaattctgttgaggtgggcggaatatatcatgtagcggtgaaatgcttagatatgatatagaacaccgattgcgaaggcagctcactaagcagcgattgacgctgaggcacgaaagcgtggggagcaaacagg

SEQ ID NO: 147 - DNA, 253 bp, Unknown
  Description of Unknown: bacterium polynucleotide
  Saprospirae; Chitinophagaceae
tacggagggtgcaagcgttatccggattcactgggtttaaagggtgcgtaggcgggttggtaagtccgtggtgaaatctccaagcttaacttggaaactgccgtggatactatcaatcttgaatatagtggaggtgagcggaatatgtcatgtagcggtgaaatgcttagatatgacatagaacacccattgcgaaggcagctcgctacactattattgacgctgaggcacgaaagcgtggggatcaaacagg

SEQ ID NO: 148 - DNA, 253 bp, Unknown
  Description of Unknown: bacterium polynucleotide
  Saprospirae; Chitinophagaceae
tacggagggtgcaagcgttatccggattcactgggtttaaagggagcgcaggcggatttgtaagtcagtggtgaaaggcttaagcttaacttgggaactgccattgatactataagtcttgaatgttgttgaggtttgcggaatgggtcatgtagcggtgaaatgcatagatatgacccggaacacctattgcgaaggcagcaggctaaacaaatattgacgctgaggctcgaaagcgtggggatcaaacagg

SEQ ID NO: 149 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcggacttttaagtcaggggtgaaatcccgaggctcaacctcggaactgcctttgatactattggtcttgagtgttgttgaggtgggcggaacgggtcatgtagcggtgaaatgcatagatatgacccggaacaccgattgcgaaggcagcccgctaagcaactattgacgctgaggcacgaaagcgtggggatcaaacagg

SEQ ID NO: 150 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcgggcttttaagtctggggtgaaatctctgagctcaactcagaaactgccttggatactattagtcttgaattatgttgaggtaggcggaatataacatgtagcggtgaaatgcatagatatgttatagaacaccgattgcgaaggcagcttactaagcatatattgacgctgatgcacgaaagcgtggggatcaaacagg

SEQ ID NO: 151 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtaggcaggtaagtcagtggtgaaatctccgggcttaacccggaaactgccattgatactatttgtcttgaataccgtggaggttagcggaatatgtcatgtagcggtgaaatgcttagagatgacatagaacaccaattgcgaaggcagctggctacacgcctattgacactgatgcacgaaagcgtggggatcaaacagg

SEQ ID NO: 152 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggctagtaagtccgtggtgaaatctctgagcttaactcggaaactgccgtggatactattagtcttgaatctcgtggaggtaagcggaatatgtcatgtagcggtgaaatgcttagatatgacatagaacaccgatagcgaaggcagcttgctacacgagtattgacactgaggcacgaaagcgtggggatcaaacagg

SEQ ID NO: 153 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggtatttaagtcagtggtgaaatctccgggctcaacccggaaactgccattgatactatttatcttgaattctgttgaggtaggcggaatatatcatgtagcggtgaaatgcttagatatgatatagaacaccgattgcgaaggcagcttactaaacagacattgacgctgaggcacgaaagcgtggggatcaaacagg

SEQ ID NO: 154 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtggattggtaagtcagtggtgtaatccccgagcttaacttgggaactgccattgatgctatcaatcttgaataccgtggaggtcagcggaatatgtcatgtagcggtgaaatgcttagatatgacatagaacatcaattgcgaaggcagctggctacgcgaatatcgacactgaggcacgaaagcgtggggatcaaacagg

SEQ ID NO: 155 - DNA, 253 bp, Unknown
  Description of Unknown: bacterium polynucleotide
  Saprospirae; Chitinophagaceae
tacggagggtgcaagcgttatccggattcactgggtttaaagggtgcgtaggcgggtttgtaagtcagtggtgaaatctctaggcttaacctggaaactgccattgatactacaggtcttgaataccttggaggtgagcggaatatgtcatgtagcggtgaaatgcttagatatgacatagaacaccgattgcgaaggcagctcactacacggtcattgacgctgaggcacgaaagcgtggggagcaaacagg

SEQ ID NO: 156 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggttgccaagtccgtggtgaaatctccgagcttaactcggaaactgccgtggatactggtaatcttgaatatcgtggaggtaagcggaatatgtcatgtagcggtgaaatgcttagatatgacatagaacaccgatagcgaaggcagcttgctacacgattattgacactgaggcacgaaagcgtggggagcaaacagg

SEQ ID NO: 157 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcggatatttaagtcagaggtgaaatctccgggctcaacccggaaactgcctttgatactatttatcttgaatttcgctgaggttggcggaatatatcatgtagcggtgaaatgcatagatatgatatagaacaccgattgcgtaggcagctggctgaacgaacattgacgctgaggcacgaaagcgtgggtagcgaacagg

SEQ ID NO: 158 - DNA, 253 bp, Unknown
  Description of Unknown: bacterium polynucleotide
  Saprospirae; Chitinophagaceae
tacggagggtgcaagcgttatccggattcactgggtttaaagggcgcgtaggcgggcaggtaagtccgtggtgaaatctctgagcttaactcagaaactgccatggatactatttgtcttgaatatcgtggaggtaagcggaatatgtcatgtagcggtgaaatgcttagatatgacatagaacaccaattgcgaaggcagcttactacacagtcattgacgctgaggcacgaaagcgtggggatcaaacagg

SEQ ID NO: 159 - DNA, 253 bp, Unknown
  Description of Unknown: bacterium polynucleotide
  Saprospirae; Chitinophagaceae
tacggagggtgcaagcgtcatccggattcactgggtttaaagggtgcgtaggtggacaagtaagtcagtggtgaaatctctgggcttaacccggaaactgccattgatactatttgtcttgaattctgtggaggtgagcggaatatgtcatgtagcggtgaaatgcttagatatgacatagaacaccgattgcgaaggcagctcactacacagcgattgacactgaggcacgaaagcgtggggatcaaacagg

SEQ ID NO: 160 - DNA, 253 bp, Unknown
  Description of Unknown: bacterium polynucleotide
  Saprospirae; Chitinophagaceae
tacggagggtgcaagcgttatccggattcactgggtttaaagggtgcgtaggcgggcaggtaagtcagaggtgaaatctccgggcttaacccggaaactgcctttgatactatcggtcttgaatatggtggaggtaagcggaatatgtcatgtagcggtgaaatgcttagagatgacatagaacacccattgcgaaggcagcttactacgcctatattgacgctgaggcacgaaagcgtggggatcaaacagg

SEQ ID NO: 161 - DNA, 253 bp, Unknown
  Description of Unknown: bacterium polynucleotide
  Saprospirae; Chitinophagaceae
tacggagggtgcgagcgttgtccggattcactgggtttaaagggtgcgtaggtgggctagtaagtccgtggtgaaatctctgagcttaactcggaaactgccgtggatactattagtcttgaatatcgtggaggtgagcagaatatgtcatgtagcggtgaaatgcttagatatggcatagaacaccgatagcgaaggcagcttgctacacgatcattgacactgaggcacgaaagcgtggggatcaaacagg

SEQ ID NO: 162 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcggatttttaagtcagtggtgaaatctccgggctcaacccggaaactgccattgatactattagtcttgaattctgttgaggtgggcggaatacatcatgtagcggtgaaatgcttagatatgatgtagaacaccgattgcgaaggcagctcactaagcagacattgacgctgaggcacgaaagcgtggggatcaaacagg

SEQ ID NO: 163 - DNA, 253 bp, Unknown
  Description of Unknown: bacterium polynucleotide
  Saprospirae; Chitinophagaceae
tacagagggtgcaagcgttatccggatttactgggtttaaagggtgcgtaggtgggcaggtaagtcagtggtgaaatcttcgagcttaactcggaaactgccattgatactatttgtcttgaatatcctggaggtaagcggaatatgtcatgtagcggtgaaatgcttagatatgacatagaacacccattgcgaaggcagcttactacgggattattgacactgaggcacgaaagcgtggggatcaaacagg

SEQ ID NO: 164 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggttagtaagtcggtggtgaaatccccgagcttaactcgggaactgccattgatactattaatcttgaatattgtggaggtcagcggaatatgtcatgtagcggtgaaatgcttagatatgacatagaacaccaattgcgaaggcagctggctaagcatatattgacactgaggcacgaaagcgtggggatcaaacagg

SEQ ID NO: 165 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggcatttaagtcagtggtgaaatctccaggctcaacctggaaactgccattgatactatttgtcttgaatatcgttgaggtaggcggaatatatcatgtagcggtgaaatgcttagatatgatatagaacaccgattgcgaaggcagcttgctaaacgattattgacgctgaggcacgaaagcgtggggatcaaacagg

SEQ ID NO: 166 - DNA, 253 bp, Unknown
  Description of Unknown: bacterium polynucleotide
  Saprospirae; Chitinophagaceae
tacgaagggtacaagcgttatccggattcactgggtttaaagggtgcgtaggtgggcaggtaagtcagtggtgaaatctccgggcttaacccggaaactgccgttgatactatctgtcttgaatgtagtggaggtgagcggaatatgtcatgtagcggtgaaatgcttagagatgacatagaacacccattgcgaaggcagctcgctacactatgattgacactgaggcacgaaagcgtggggagcaaacagg

SEQ ID NO: 167 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggcgagtaagtccgtggtgaaatcctgcagcttaactgcagaactgccatggatactatttgtcttgaatatcgtggagatcagcggaatatgtcatgtagcggtgaaatgcttagatatgacatagaacacctattgcgaaggcagctggttacgcgaatattgacactgaggcacgaaagcgtggggatcaaacagg

SEQ ID NO: 168 - DNA, 253 bp, Unknown
  Description of Unknown: bacterium polynucleotide
  Saprospirae; Chitinophagaceae
tacggagggtgcaagcgttatccggattcactgggtttaaagggtgcgtaggcgggtaagtaagtcagtggtgaaatctccgggcttaactcggaaactgccgttgatactatttatcttgaatatcatggaggtaagcggaatatgtcatgtagcggtgaaatgcttagatatgacatagaacaccgatagcgaaggcagcttactacatgttaattgacgctgaggcacgaaagcgtggggagcaaacagg

SEQ ID NO: 169 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcggacttttaagtcagtggtgaaatctccgggctcaacccggaaactgccattgatactattggtcttgaatgttgttgaggtgggcggaacgggtcatgtagcggtgaaatgcatagatatgacccggaacaccgattgcgtaggcagcccactaagcaacgattgacgctgaggcacgaaagcgtggggatcaaacagg

SEQ ID NO: 170 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggttggtaagtccgtggtgaaatctccgagcttaactcggaaactgccgtggatactatcaatcttgaatactgtggaggtaagcggaatatgtcatgtagcggtgaaatgcttagatatgatatagaacaccgatagcggaggcagcttgctacacagtcattgacactgaggcacgaaagcgtggggatcaaacagg

SEQ ID NO: 171 - DNA, 253 bp, Unknown
  Description of Unknown: bacterium polynucleotide
  Saprospirae; Chitinophagaceae
tacggagggtgcaagcgttatccggattcactgggtttaaagggtgcgtaggcgggttggtaagtcagtggtgaaatcttcaagcttaacttggaaactgccgttgatactatcaatcttgaatattgtggaggtaagcggaatatgtcatgtagcggtgaaatgcttagatatgacatagaacaccgatagcgaaggcagcttgctacacagtagttgacgctgaggcacgaaagcgtggggatcaaacagg

SEQ ID NO: 172 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggtatgtaagtcagtggtgaaatccccgagcttaacttgggaactgccgttgatactatatatcttgaatgccgtagaggtaagcggaatatgtcatgtagcggtgaaatgcttagatatgacatagaacaccaattgcgaaggcagcttactatgcggttattgacactgaggcacgaaagcgtgggtagcaaacagg

SEQ ID NO: 173 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcgggcctttaagtctggggtgaaatctccgagctcaactcggaaactgccctggatactattggccttgaattatgttgaggttggcggaatataacatgtagcggtgaaatgcatagatatgttatagaacaccgattgcgaaggcagctaactaagcatatattgacgctgaggcacgaaagcgtggggatcaaacagg

SEQ ID NO: 174 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggcggctaagtcagtggtgaaatctccgggctcaacccggaaactgccattgatactatctgtcttgaatattgttgaggtaggcggaatatatcatgtagcggtgaaatgcatagatatgatatagaacaccgattgcgaaggcagcttactaaacaattattgacgctgaggcacgaaagcgtggggatcaaacagg

SEQ ID NO: 175 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcggatatttaagtcagaggtgaaatctccaggctcaacctggaaactgcctttgatactatttatcttgaattttgttgaggtaggcggaatacatcatgtagcggtgaaatgcttagatatgatgtagaacaccgattgcgaaggcagcttactaaacaaacattgacgctgaggcacgaaagcgtggggatcaaacagg

SEQ ID NO: 176 - DNA, 252 bp, Unknown
  Description of Unknown: bacterium polynucleotide
  Saprospirae; Chitinophagaceae
tacggagggtgcaagcgttatccggattcactgggtttaaagggtgcgtaggtgggcaggtaagtcagtggtgaaatctccgggtttaactcggaaactgcgttgatactatctgtcttgaatatcgtggaggttagcggaatatgtcatgtagcggtgaaatgcttagatatgacatagaacacccattgcgaaggcagctaactacacgatcattgacactgaggcacgaaagcgtggggagcaaacagg

SEQ ID NO: 177 - DNA, 253 bp, Unknown
  Description of Unknown: bacterium polynucleotide
  Saprospirae; Chitinophagaceae
tacgaagggtgcaagcgttatccggattcactgggtttaaagggtgcgtaggtgggcaggtaagtcagtggtgaaacctccgggcttaacccggaaactgccattgatactatcagtcttgaataccctggaggtgagcggaatatgtcatgtagcggtgaaatgcttagatatgacatagaacacccattgcgaaggcagctcactacgggaatattgacactgaggcacgaaagtgtggggatcaaacagg

SEQ ID NO: 178 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggcaggtaagtcagtggtgaaatctctgggcttaacccggaaactgccgttgatactatctgtcttgaatgtagtggaggtgagcggaatatgtcatgtagcggtaaaatgcttagatatgacatagaacatctattgcgaaggcagctcgctacactatgattgacactgaggcacgaaagcgtggggatcaaacagg

SEQ ID NO: 179 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcggacttttaagtcagcggtgaaatctccgggctcaacccggaaactgccattgatactattagtcttgaatcttgttgaggtaggcggaacgggtcatgtagcggtgaaatgcatagatatgacccggaacaccgattgcgaaggcagcctactaagcaagtattgacgctgaggcacgaaagcgtggggatcaaacagg

SEQ ID NO: 180 - DNA, 253 bp, Unknown
  Description of Unknown: bacterium polynucleotide
  Saprospirae; Chitinophagaceae
tacggagggtgcaagcgttatccggatttactgggtttaaagggtgcgtaggtgggtctgtaagtcagtggtgaaatctccgggcttaacccggaaactgccattgatactataggtcttgaatactctggaggtaagcggaatatgtcatgtagcggtgaaatgcttagatatgacatagaacaccaattgcgaaggcagcttactacggggtcattgacactgaggcacgaaagcgtggggatcaaacagg

SEQ ID NO: 181 - DNA, 253 bp, Unknown
  Description of Unknown: bacterium polynucleotide
  Saprospirae; Chitinophagaceae
tacggagggtgcaagcgttatccggattcactgggtttaaagggtgcgtaggcgggtaggtaagtcagtggtgaaatcttcgagctcaactcggaaattgccgttgatactatttatcttgaatatcgttgaggtttgcggaatatgtcatgtagcggtgaaatgcttagagatgacatagaacacctattgcgaaggcagcaggctaaacgaacattgacgctgaggcacgaaagcgtggggatcaaacagg

SEQ ID NO: 182 - DNA, 253 bp, Unknown
  Description of Unknown: bacterium polynucleotide
  Saprospirae; Chitinophagaceae
tacgtagggtgcaagcgttatccggattcactgggtttaaagggtgcgtaggtggaatggtaagtcagtggtgaaatctccaagcttaacttggaaactgccgttgatactatcattcttgaatatcgtggaggtaagcggaatatgtcatgtagcggtgaaatgcttagatacgacatagaacaccgattgcgaaggcagcttgctacacgatcattgacactgaggcacgaaagcgtggggatcagacagg

SEQ ID NO: 183 - DNA, 253 bp, Unknown
  Description of Unknown: bacterium polynucleotide
  Saprospirae; Chitinophagaceae
tacggagggtgcaagcgttatccggatttactgggtttaaagggtgcgtaggcgggtctttaagtcagtggtgaaaacttcgagcttaactcgaaaactgccattgatactattgatcttgaatttagttgaggttggcggaatgtgtcatgtagcggtgaaatgcttagatatgacacagaacaccgattgcgaaggcagctgactaaactaaaattgacgctgaggcacgaaagtgtggggatcaaacagg

SEQ ID NO: 184 - DNA, 254 bp, Unknown
  Description of Unknown: bacterium polynucleotide
  Saprospirae; Chitinophagaceae
tacggagggtgcgagcgttatccggattcactgggtttaaagggtgcgtaggtgggcatttaagtcagtggtgaaatctccgggcttaacccggaaactgccattgatactatatgtcttgaataccgtggaggtgagcggaatatgtcatgtagcggtgaaatgcttagatatgacatagaacaccaattgcgaaggcagctcactacacggactattgacactgaggcacgaaagcgtggggatcaaacagg

SEQ ID NO: 185 - DNA, 253 bp, Unknown
  Description of Unknown: bacterium polynucleotide
  Saprospirae; Chitinophagaceae
tacggagggtgcaagcgttatccggatttactgggtttaaagggtgcgtaggtgggtaggaaagtcagtggtgaaatcttcgggcttaacccggaaactgccattgatactatttatcttgaatactctggaggtaagcggaatatgtcatgtagcggtgaaatgcttagatatgacatagaacaccaattgcgaaggcagcttactacatagttattgacactgaggcacgaaagcgtggggagcaaacagg

SEQ ID NO: 186 - DNA, 253 bp, Unknown
  Description of Unknown: bacterium polynucleotide
  Saprospirae; Chitinophagaceae
tacggagggtgcaagcgttatccggatttactgggtttaaagggtgcgcaggcggatatgtaagtcagtggtgaaatctttgggcttaacccgaaaattgccattgatactatatatcttgaatgctgtggaggtaagcggaatatgtcatgtagcggtgaaatgcttagatatgacatggaacacctattgcgaaggcagcttactacgcagatattgacgctcatgcacgaaagcgtggggatcaaacagg

SEQ ID NO: 187 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggttggtaagtcagtggtgaaatccccgagcttaacttgggaactgccactgatactatcagtcttgaatattgtggaggttagcggaatatgtcatgtagcggtaaaatgcttagatatgacatagaacaccaattgcgtaggcagcttactacacgaatattgacgctgaggcacgaaagcgtggggagcaaacagg

SEQ ID NO: 188 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggctgttaagtcagtggtgaaatctccgggctcaacccggaaactgccattgatactatcagtcttgaatatcgttggggtaggcggaatatatcatgtagcggtgaaatgcatagatatgatatagaacaccaattgcgaaggcagcttactaaacgatcattgacgctgaggcacgaaagcgtggggatcaaacagg

SEQ ID NO: 189 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggtctgtaagtcagtggtgaaatctccgagcttaacttggaaactgccattgatactgtagatcttgaataccgtggaggtcagcggaatatgtcatgtagcggtgaaatgcttagatatgacatagaacaccaattgcgaaggcagctggctacacgaatattgacactgatgcacgaaagcgtggggatcaaacagg

SEQ ID NO: 190 - DNA, 253 bp, Unknown
  Description of Unknown: bacterium polynucleotide
  Saprospirae; Chitinophagaceae
tacggagggtgcaagcgttatccggattcactgggtttcaagggtgtgtaggcgggcgtttaagtcagtggtgaaatctccgagcttaacttggaaactgccattgatactattcgtcttgaattctgttgaggtgggcggaatatgtcatgtagcggtgaaatgcatagatatgacatagaacaccgattgcgaaggcagctcactaagcagatattgacgctgaggcacgaaagcgtggggatcaaacagg

SEQ ID NO: 191 - DNA, 253 bp, Unknown
  Description of Unknown: bacterium polynucleotide
  Saprospirae; Chitinophagaceae
tacggagggtgcaagcgttatccggatttactgggtttaaagggtgcgtaggtgggtctgtaagtcagtggtgaaatctccgagcttaactcggaaactgccattgatactatagatcttgaatatcctggaggtgagcggaatatgtcatgtagcggtgaaatgcttagatatgacatagaacaccaattgcgaaggcagctcactacgggattattgacactgaggcacgaaagcgtggggatcaaacagg

SEQ ID NO: 192 - DNA, 253 bp, Unknown
  Description of Unknown: bacterium polynucleotide
  Saprospirae; Chitinophagaceae
tacggagggtgcaagcgttatccggatttactgggtttaaagggagcgcaggcggactggtaagtcagtggtgaaagccttgagcttaactcgagaactgccattgataccatcagtcttgaatgttgttgaggtttgcggaatgggtcatgtagcggtgaaatgcatagatatgacccggaacacctattgcgaaggcagcaggctaaacaaatattgacgctgaggctcgaaagcgtggggatcaaacagg

SEQ ID NO: 193 - DNA, 253 bp, Unknown
  Description of Unknown: bacterium polynucleotide
  Saprospirae; Chitinophagaceae
tacggagggtgcaagcgttgtccggatttattgggtttaaagggtgcgtaggcggacttttaagtcagcggtaaaatctccgggctcaacccggaaactgccattggtactattggtcttgaatgttgttgaggtgggcggaacgggtcatgtagcggtgaaatgcatagatatgacccggaacaccgattgcgaaggcagcccactaagcaatgattgacgctgaggcacgaaagcgtggggatcaaacagg

SEQ ID NO: 194 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggcagttaagtcagtggtgaagtctccgggcttaacccggaaactgccattgatactacctgtcttgaatgccgtggaggtaagcggaatatgtcatgtagcggtgaaatgcttagatatgacatagaacaccaattgcgaaggcagcttactacacgaatattgacactgaggcacgaaagcgtggggatcaaacagg

SEQ ID NO: 195 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcggacttttaagtcagcggtgaaatctccgggctcaacccggaaactgccattgatactattggtcttgaatgttgtggaggtgggcggaacgggtcatgtagcggtgaaatgcttagagatgacccggaacaccgattgcgaaggcagcccactacgcaactattgacgctgaggcatgaaagcgtggggatcaaacagg

SEQ ID NO: 196 - DNA, 253 bp, Unknown
  Description of Unknown: bacterium polynucleotide
  Saprospirae; Chitinophagaceae
tacggagggtgcaagcgttatccggattcactgggtttaaagggagcgtaggtgggtcggtaagtcagtggtgaaatccccgagcttaacttgggaactgccattgatactatcgatcttgaatactgtggaggtaagcggaatatatcatgtagcggtgaaatgcttagatatgatatagaacaccaatagcgaaggcagcttactacgcagttattgacactgaggctcgaaagcgtggggatcaaacagg

SEQ ID NO: 197 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcggacaattaagtctggggtgaaatctccgagctcaactcggaaactgccttggatactatttgtcttgaattatgttgaggtaggcggaatataacatgtagcggtgaaatgcatagatatgttatagaacaccgattgcgaaggcagcttactaagcatatattgacgctgaggcacgaaagcgtgggtagcgaacagg

SEQ ID NO: 198 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcgggcttttaagtcagtggtgaaatctccgggctcaacctggaaactgccattgatactattagacttgaattttgttgaggtaggcggaataagtcatgtagcggtgaaatgcatagatatgacttagaacaccaattgcgaaggcagcttactaaacaaatattgacgctgaggcacgaaagcgtggggatcaaacagg

SEQ ID NO: 199 - DNA, 253 bp, Unknown
  Description of Unknown: bacterium polynucleotide
  Saprospirae; Chitinophagaceae
tacggagggtgcaagcgttatccggattcactgggtttaaagggtgcgcaggtgggctggtaagtccgtggtgaaatctctgagcttaactcagaaactgccgtggatactatcagtcttgaatatcgcggaggtaagcggaatatgtcatgtagcggtgaaatgcttagatatgacatggaacaccaattgcgaaggcagcttactacacgattattgacgctgaggcacgaaagcgtggggagcaaacagg

SEQ ID NO: 200 - DNA, 253 bp, Unknown
  Description of Unknown: bacterium polynucleotide
  Saprospirae; Chitinophagaceae
tacggagggtgcaagcgttatccggatttactgggtttaaagggtgcgtaggtgggcaggaaagtcagtggtgaaatctccgggcttaacccggaaactgccattgatactatttgtcttgaatactttggaggtaagcggaatatgtcatgtagcggtgaaatgcttagatatgacatagaacaccaattgcgcaggcagcttactacacagtgattgacactgaggcacgaaagcgtggggatcaaacagg

SEQ ID NO: 201 - DNA, 253 bp, Unknown
  Description of Unknown: bacterium polynucleotide
  Saprospirae; Chitinophagaceae
tacgtagggtgcaagcgttatccggattcactgggtttaaagggtgcgtaggcgggcaggtaagtcaatggtgaaatcttcgagcttaactcggaaactgccgttgatactatctgtcttgaataacgttgaggtgagcggaatgtgtcatgtagcggtgaaatgcttagatatgacatagaacaccgattgcgaaggcagctcactaaacgctcattgacgctgaggcacgaaagcgtggggatcaaacagg

SEQ ID NO: 202 - DNA, 253 bp, Unknown
  Description of Unknown: bacterium polynucleotide
  Saprospirae; Chitinophagaceae
tacggagggtgcaagcgttatccggatttactgggtttaaagggtgcgtaggtgggtctgtaagtcagtggtgaaatcttcgagcttaactcggaaactgccattgatactataggtcttgaatcatctggaggtgagcggaatatgtcatgtagcggtgaaatgcttagatatgacatagaacaccgattgcgaaggcagctcactacggatgtattgacactgaggcacgaaagcgtggggatcaaacagg

SEQ ID NO: 203 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggctgttaagtcagtggtgaaatctccgggctcaacccggaaactgccattgatactatcagtcttgaattctgttgaggtgggcggaatatgtcatgtagcggtgaaatgcatagatatgacatagaacaccaattgcgaaggcagctcactaaacagcgattgacgctgaggcacgaaagcgtggggatcaaacagg

SEQ ID NO: 204 - DNA, 253 bp, Unknown
  Description of Unknown: bacterium polynucleotide
  Saprospirae; Chitinophagaceae
tacggaggatgcaagcgttatccggattcactgggtttaaagggtgcgtaggtgggcaggtaagtcagtggtgaaatccccgagcttaactcgggaactgccgttgatactatctatcttgaatatcgtggaggtaagcggaatatgtcatgtagcggtgaaatgcttagatatgacatagaacacccattgcgaaggcagcttactacacgatcattgacactgaggcacgaaagcgtggggagcaaacagg

SEQ ID NO: 205 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcggacttttaagtcaggggtgaaatctccgagctcaactcggaaactgcctttgatactattagtcttgaattatgttgaggttggcggaatataacatgtagcggtgaaatgcatagatatgttatagaacaccgattgcgaaggcagctggctaaacatatattgacgctgaggcacgaaagcgtgggtagcgaacagg

SEQ ID NO: 206 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggtatttaagtcagtggtaatatctccgagctcaactcggaaactgccattgatactatttatcttgaatattgttgaggtaggcggaatatgtcatgtagcggtgaagtgcttagatatgacatagaacaccgattgcgaaggcagcttgctaaacaattattgacgctgaggcacgaaagcgtggggatcaaacagg

SEQ ID NO: 207 - DNA, 253 bp, Unknown
  Description of Unknown: bacterium polynucleotide
  Saprospirae; Chitinophagaceae
tacggagggtgcaagcgttatccggatttactgggtttaaggggtgtgtaggcgggcatttaagtcagcggtgaaatctccgggctcaacctggaaactgccattgatactatttgtcttgaattttgttgaggttggcggaatatgtcatgtagcggtgaaatgcatagatatgtggaggaacaccgatggcgaaggcagccccctgggtcaaaactgacgctcatgcacgaaagcgtggggagcaaatagg

SEQ ID NO: 208 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggtatttaagtcagtggtgagatcctacagcttaactgtagaactgccattgatactctttaccttgaatattgttgaggtaggcggaatacatcatgtagcggtgaaatgcttagatatgatgtagaacaccgattgcgaaggcagcttactaagcaaatattgacgctgaggcacgaaagcgtggggatcaaacagg

SEQ ID NO: 209 - DNA, 253 bp, Unknown
  Description of Unknown: bacterium polynucleotide
  Saprospirae; Chitinophagaceae
tacagagggtgcaagcgttatccggattcactgggtttaaagggagcgtaggtgggcttgtaagtcagtggtgaaatctccgtgcttaacacggaaactgccattgatactataggtcttgaatattctggaggttagcggaatatgtcatgtagcggtgaaatgcttagatatgacatagaacaccaattgcgaaggcagctaactacagggttattgacactgaggctcgaaagcgtggggagcaaacagg

SEQ ID NO: 210 - DNA, 253 bp, Unknown
  Description of Unknown: bacterium polynucleotide
  Saprospirae; Chitinophagaceae
tacgtagggtgcaagcgttatccggatctactgggtttaaagggtgtgtaggcgggctattaagtttggggtgaaatctccgtgctcaactcggaaactgccttggatactattagtcttgaattatgttgaggttggcggaatataacatgtagcggtgaaatgcatagatatgttatagaacaccgattgcgaaggcagctaactaagcatatattgacgctgaggcacgaaagcgtggggatcaaacagg

SEQ ID NO: 211 - DNA, 253 bp, Unknown
  Description of Unknown: bacterium polynucleotide
  Saprospirae; Chitinophagaceae
tacggagggtgcaagcgttatccggattcactgggtttaaagggtgcgtaggtgggcaggtaagtcagtggtgaaatctctaagcttaacttagaaactgccgttgatactatctgtcttgaatgtagtggaggtgagcggaatatgtcatgtagcggtgaaatgcttagagatgacatagaacaccaattgcgaaggcagcttgctacactacgattgacactgaggcacgaaagcgtggggatcaaacagg

SEQ ID NO: 212 - DNA, 253 bp, Unknown
  Description of Unknown: bacterium polynucleotide
  Saprospirae; Chitinophagaceae
tacggagggtgcaagcgttatccggattcactgggtttaaagggtgtgtaggcgggcaggtaagtccgaggtgaaatctctgagctcaactcagaaactgccttggatactatttgtcttgaatatcgttgaggttggcggaatatgtcatgtagcggtgaaatgcttagatatgacatagaacaccgattgcgaaggcagctagctaaacgattattgacgctgaggcacgaaagcgtggggatcaaacagg

SEQ ID NO: 213 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcgggtcattaagtcagtggtgaaatctccgggctcaacccggaaactgccattgatactattggtcttgaatgttgtggaggtgggcggaatgtgtcatgtagcggtgaaatgcatagatatgacacagaacaccgattgcgaaggcagcccactacgcaaatattgacgctgaggcacgaaagcgtggggatcaaacagg

SEQ ID NO: 214 - DNA, 253 bp, Unknown
  Description of Unknown: bacterium polynucleotide
  Saprospirae; Chitinophagaceae
tacggagggtgcaagcgttatccggattcactgggtttaaagggtgcgtaggcggacaggtaagtcagtggtgaaatctccgagcttaactcggaaactgccgttgatactatttgtcttgaatattgtggaggtaagcggaatatgtcatgtagcggtgaaatgcttagatatgacatagaacaccaattgcgaaggcagcttactacacaatgattgacgctgaggcacgagagcgtggggatcaaacagg

SEQ ID NO: 215 - DNA, 253 bp, Unknown
  Description of Unknown: bacterium polynucleotide
  Saprospirae; Chitinophagaceae
tacggagggtgcaagcgttatccggattcactgggtttaaagggtgcgtaggcgggcaggtaagtcagtggtgaaatctttgggcttaacccgaaaactgccattgatactatatgtcttgaattacctggaggttagcggaatatgtcatgtagcggtgaaatgcttagatatgacatagaacacccattgcgaaggcagctaactacgggtatattgacgctgaggctcgaaagcgtggggatcaaacagg

SEQ ID NO: 216 - DNA, 253 bp, Unknown
  Description of Unknown: bacterium polynucleotide
  Saprospirae; Chitinophagaceae
tacggagggtgcaagcgttatccggatttactgggtttaaagggtgtgtaggcggacttttaagtcagaggtgaaatctccgagctcaactcggaaactgcccctgatactattggtcttgaatatcgttgaggtaggcggaatacatcatgtagcggtgaaatgcttagatatgatgtggaacaccgattgcgaaggcagcttactaaacgattattgacgctgaggcacgaaagcgtggggagcgaacagg

SEQ ID NO: 217 - DNA, 253 bp, Chitinophaga sp.
  Saprospirae; Chitinophagaceae; Chitinophaga
tacggagggtgcaagcgttatccggattcactgggtttaaagggtgcgtaggcggattattaagtccgtggtgaaatctccaagcttaacttggaaactgccatggatactattagtcttgaatgttgtggaggttagcggaatatgtcatgtagcggtgaaatgcatagatatgacatagaacaccaattgcgaaggcagctggctacacaaatattgacgctgaggcacgaaagcgtggggatcaaacagg

SEQ ID NO: 218 - DNA, 253 bp, Chitinophaga sp.
  Saprospirae; Chitinophagaceae; Chitinophaga
tacggagggtgcaagcgttatccggattcactgggtttaaagggtgcgtaggcggattagaaagtccgttgtgaaatctctgagcttaactcggaaattgcggtggatactattagtcttgaatactgtggaggttagcggaatatgtcatgtagcggtgaaatgcatagatatgacatagaacaccaattgcgaaggcagctggctacacagatattgacgctgaggcacgaaagcgtggggatcaaacagg

SEQ ID NO: 219 - DNA, 253 bp, Chitinophaga sp.
  Saprospirae; Chitinophagaceae; Chitinophaga
tacgaagggggctagcgttatccggattcactgggtttaaagggtgcgtaggcggacttgtaagtccgtggtgaaatctccgagcttaactcggaaactgccatggatactataggtcttgaatgttgttgaggttagcggaatagttcatgtagcggtgaaatgcttagatatgacctagaacaccgattgcgaaggcagctggctacacaacgattgacgctgaggcacgaaagcgtggggatcaaacagg

SEQ ID NO: 220 - DNA, 253 bp, Chitinophaga sp.
  Saprospirae; Chitinophagaceae; Chitinophaga
tacggagggtgcaagcgttatccggattcactgggcttaaagggtgcgtaggcggatttgtaagtccgtggtgaaatctctaagcttaacttggaaactgccatggatactataagtcttgaatattgtggaggttagcggaatatgtcatgtagcggtgaaatgcatagatacgacatagaacaccaattgcgaaggcagctggctacacaaatattgacgctgatgcacgaaagcgtggggatcaaacagg

SEQ ID NO: 221 - DNA, 253 bp, Chitinophaga sp.
  Saprospirae; Chitinophagaceae; Chitinophaga
tacggagggtgcaagcgttatccggattcactgggtttaaagggtgcgtaggcggaattgtaagtccgtggtgaaatctccaagcttaacttggaaactgccgtggatactatagttcttgaatgttgtggaggtttgcggaatatgtcatgtagcggtgaaatgcttagatatgacatagaacaccgattgcgaaggcagcaggctacacaaatattgacgctgaggcacgaaagcgtggggatcaaacagg

SEQ ID NO: 222 - DNA, 253 bp, Chitinophaga sp.
  Saprospirae; Chitinophagaceae; Chitinophaga
tacggagggtgcaagcgttatccggattcactgggtttaaagggtgcgtaggcggatttttaagtccgtggtgaaatctccgagcttaactcggaaactgccatggatactataagtcttgaatgttgtggaggtttgcggaatatgtcatgtagcggtgaaatgcttagatatgacatagaacaccgattgcgaaggcagcaggctacacaaatattgacgctgaggcacgagagcgtggggatcaaacagg

SEQ ID NO: 223 - DNA, 253 bp, Chitinophaga sp.
  Saprospirae; Chitinophagaceae; Chitinophaga
tacggagggtgcaagcgttatccggattcactgggtttaaagggtgcgtaggcggaacagaaagtccgttgtgaaatctccgagcttaactcggaaattgcggtggatactattgttcttgaatactgttgaggttagcggaatatgtcatgtagcggtgaaatgcatagatatgacatagaacaccaattgcgaaggcagcttactaaacgaagattgacgctgaggcacgaaagcgtggggatcaaacagg

SEQ ID NO: 224 - DNA, 253 bp, Chitinophaga sp.
  Saprospirae; Chitinophagaceae; Chitinophaga
tacggagggtgcaagcgttatccggattcactgggtttaaagggtgcgtaggcggacatgtaagtctgtggtgaaatctccgagcttaactcggaaactgccgtggatactatatgtcttgaatgttgtggaggttagcggaatatgtcatgtagcggtgaaatgcttagatatgacatagaacaccgattgcgaaggcagctggctacacaactattgacgctgaggcacgaaagcgtggggatcaaacagg

SEQ ID NO: 225 - DNA, 253 bp, Ferruginibacter lapsinanis
  Saprospirae; Chitinophagaceae; Ferruginibacter lapsinanis
tacggagggtgcaagcgttatccggatttactgggtttaaagggtgcgtaggtgggtcagtaagtcagtggtgaaatcttcgagcttaactcggaaactgccattgatactattgaccttgaattatctggaggtaagcggaatatgtcatgtagcggtgaaatgcttagatatgacatagaacacccattgcgaaggcagcttactacggatcgattgacactgaggcacgaaagcgtggggatcaaacagg

SEQ ID NO: 226 - DNA, 253 bp, Ferruginibacter lapsinanis
  Saprospirae; Chitinophagaceae; Ferruginibacter lapsinanis
tacggagggtgcaagcgttatccggatttactgggtttaaagggagcgtaggtgggtcggtaagtcagtggtgaaatcttcgagcttaactcggaaactgccaatgatactatcgatcttgaattatctggaggtaagcggaatatgtcatgtagcggtgaaatgcttagatatgacatagaacacccattgcgaaggcagcttactacggatatattgacactgaggctcgaaagcgtggggatcaaacagg

SEQ ID NO: 227 - DNA, 253 bp, Flavisolibacter sp.
  Saprospirae; Chitinophagaceae; Flavisolibacter
tacggagggtgcaagcgttatccggattcactgggtttaaagggtgcgtaggcgggcaggtaagtccgtggtgaaatctctgagcttaactcagaaactgccgtggatactatctgtcttgaataccgtggaggtgagtggaatatgtcatgtagcggtgaaatgcttagatatgacatagaacaccaattgcgaaggcagctcactacacgcctattgacgctgaggcacgaaagcgtggggatcaaacagg

SEQ ID NO: 228 - DNA, 253 bp, Flavisolibacter sp.
  Saprospirae; Chitinophagaceae; Flavisolibacter
tacggagggtgcaagcgttatccggattcactgggtttaaagggtgcgtaggagggcagggaagtcagtggtgaaatctccgggcttaactcggaaactgccgttgatactctctgtcttgaatcccgtggaggtgagcggaatatgtcatgtagcggtgaaatgcttagatatgacatagaacaccgattgcgaaggcagctcgctacacgaagattgactctgaggcacgaaagcgtggggatcaaacagg

SEQ ID NO: 229 - DNA, 253 bp, Flavisolibacter sp.
  Saprospirae; Chitinophagaceae; Flavisolibacter
tacggagggtgcaagcgttatccggattcactgggtttaaagggtgcgtaggcgggcaggtaagtcagtggtgaaatcttggggcttaaccccgaaactgccgttgatactatctgtcttgaatactcgggaggtgagcggaatatgtcatgtagcggtgaaacgcttagatatgacatagaacaccaattgcgaaggcagctcactacagagtcattgacgctgaggcacgaaagcgtggggatcaaacagg

SEQ ID NO: 230 - DNA, 253 bp, Flavisolibacter sp.
  Saprospirae; Chitinophagaceae; Flavisolibacter
tacggagggtgcaagcgttatccggattcactgggtttaaagggtgcgtaggagggcaggtaagtcagtggtgaaatctccgagcttaactcggaaactgccgttgatactatctgtcttgaataccgtggaggtgagcggaatatgtcatgtagcggtgaaatgcttagatatgacatagaacaccaattgcgaaggcagctcactacacgagcattgactctgaggcacgaaagcgtggggatcaaacagg

SEQ ID NO: 231 - DNA, 253 bp, Flavisolibacter sp.
  Saprospirae; Chitinophagaceae; Flavisolibacter
tacggagggtgcaagcgttatccggattcactgggtttaaagggtgcgtaggtgggcaggtaagtccgtggtgaaatctctgagcttaactcagaaactgccgtggatactatctgtcttgaatattgtggaggtgagcggaatatgtcatgtagcggtgaaatgcttagatatgacatagaacaccaattgcgaaggcagctcactacacagtaattgacgctgaggcacgaaagcgtggggatcaaacagg

SEQ ID NO: 232 - DNA, 253 bp, Flavisolibacter sp.
  Saprospirae; Chitinophagaceae; Flavisolibacter
tacggagggtgcaagcgttatccggattcactgggtttaaagggagcgtaggagggcaggtaagtcagtggtgaaatcttcgagcttaactcggaaactgccgttgatactatctgtcttgaataccgtggagatgagcggaatatgtcatgtagcggtgaaatgcttagatatgacatagaacaccaattgcgaaggcagctcgttacacgaatattgactctgaggctcgaaagcgtggggatcaaacagg

SEQ ID NO: 233 - DNA, 253 bp, Flavisolibacter sp.
  Saprospirae; Chitinophagaceae; Flavisolibacter
tacggagggtgcaagcgttatccggattcactgggtttaaagggtgcgtaggaggactggtaagtcagtggtgaaatccccgagcttaacttgggaactgccgttgatactatcagtcttgaataccgtggaggtgagcggaatatgtcatgtagcggtgaaatgcttagatatgacatagaacaccaattgcgaaggcagctcgctaaacgaatattgactctgaggcacgaaagcgtggggatcaaacagg

SEQ ID NO: 234 - DNA, 253 bp, Flavisolibacter sp.
  Saprospirae; Chitinophagaceae; Flavisolibacter
tacggagggtgcaagcgttatccggattcactgggtttaaagggtgcgtaggtgggtctgtaagtccgtggtgaaatctccaagcttaacttggaaactgccatggatactataggtcttgaataccgtggaggtgagcggaatatgtcatgtagcggtgaaatgcttagatatgacatagaacaccaattgcgaaggcggctcactacacgaatattgacactgaggcacgaaagcgtggggatcaaacagg

SEQ ID NO: 235 - DNA, 253 bp, Flavisolibacter sp.
  Saprospirae; Chitinophagaceae; Flavisolibacter
tacggagggtgcaagcgttatccggattcactgggtttaaagggtgcgtaggcgggtgagtaagtccgtggtgaaatctctgagcttaactcagaaactgccgtggatactatttgccttgaatattgtggaggtgagcggaatatgtcatgtagcggtgaaatgcttagatatgacatagaacaccaattgcgaaggcagctcactacacaattattgacgctgaggcacgaaagcgtggggatcaaacagg

SEQ ID NO: 236 - DNA, 253 bp, Flavisolibacter sp.
  Saprospirae; Chitinophagaceae; Flavisolibacter
tacggagggtgcaagcgttatccggattcactgggtttaaagggtgcgtaggcgggcaggtaagtccgtggtgaaatctccgagcttaactcggaaactgccatggatactatttgtcttgaatactgtggaggtgagcggaatatgtcatgtagcggtgaaatgcttagatatgacatagaacaccaattgcgaaggcagctcactgcgcagtgattgacgctgaggcacgaaagcgtggggatcaaacagg

SEQ ID NO: 237 - DNA, 253 bp, Flavisolibacter sp.
  Saprospirae; Chitinophagaceae; Flavisolibacter
tacggagggtgcaagcgttatccggattcactgggtttaaagggtgcgtaggtgggtctgtaagtcagtggtgaaatctccaagcttaacttggaaactgccgttgatactatagctcttgaatgttgtggaggtgagcggaatatgtcatgtagcggtgaaatgcttagatatgacatagaacaccaattgcgaaggcagctcactacacaaatattgacactgaggcacgaaagcgtggggatcaaacagg

SEQ ID NO: 238 - DNA, 253 bp, Flavisolibacter sp.
  Saprospirae; Chitinophagaceae; Flavisolibacter
tacggagggtgcaagcgttatccggattcactgggtttaaagggtgcgtaggcgggcaggtaagtccgtggtgaaatccccgagcttaactcgggaactgccgtggatactatctgtcttgaatattgtggaggttagcggaatatgtcatgtagcggtgaaatgcttagatatgacatagaacaccaattgcgaaggcagctcgctacacgaatattgactctgaggcacgaaagcgtggggatcaaacagg

SEQ ID NO: 239 - DNA, 253 bp, Flavisolibacter sp.
  Saprospirae; Chitinophagaceae; Flavisolibacter
tacggagggtgcaagcgttatccggattcactgggtttaaagggtgcgtaggagggcaggtaagtcagtggtgaaatctccgagcttaacttggaaactgccgttgatactatctgtcttgaatattgtggaggtgagcggaatatgtcatgtagcggtgaaatgcttagatatgacatagaacaccaattgtgaaggcagctcgctacacatatattgactctgaggcacgaaagcgtggggatcaaacagg

SEQ ID NO: 240 - DNA, 253 bp, Flavisolibacter sp.
  Saprospirae; Chitinophagaceae; Flavisolibacter
tacggagggtgcaagcgttatccggattcactgggtttaaagggtgcgtaggagggcaggtaagtcagtggtgagatctccaagcttaacttggaaactgccgttgatactatctgtcttgaataccgtggaggtgagcggaatatgtcatgtagcggtgaaatgcttagatatgacatagaacaccaattgcgaaggcggctcgctacacgaatattgactctgaggcacaaaagcgtggggatcaaacagg

SEQ ID NO: 241 - DNA, 254 bp, Flavisolibacter sp.
  Saprospirae; Chitinophagaceae; Flavisolibacter
tacgtagggtgcaagcgttatccggattcactgggtttaaagggtgcgtaggagggcaggtaagtcagtggtgaaatcctggggcttaaccccagaactgccgttgatactatcggtcttgaatatcgtggaggtaagcggaatatgtcatgtagcggtgaaatgcttagagatgacatagaacaccaattgcgaaggcagcttactacccgtcttattgactctgaggcacgaaagcgtggggatcaaacagg

SEQ ID NO: 242 - DNA, 253 bp, Flavisolibacter sp.
  Saprospirae; Chitinophagaceae; Flavisolibacter
tacggagggtgcaagcgttatccggattcactgggtttaaagggtgcgtaggcgggtgggtaagtcagtggtgaaatcccggagtttaactctggaactgccgttgatactatccatcttgaatactcgggaggtgagcggaatatgtcatgtagcggtgaaatgcttagatatgacatagaacaccaattgcgcaggcagctcactacagagtcattgacgctgaggcacgaaagcgtggggatcaaacagg

SEQ ID NO: 243 - DNA, 253 bp, Flavisolibacter sp.
  Saprospirae; Chitinophagaceae; Flavisolibacter
tacggagggtgcaagcgttatccggattcactgggtttaaagggtgcgtaggagggcagggaagtccgtggtgaaatctccgagcttaactcggaaactgccgtggatactctctgtcttgaatcccctggaggtgagtggaatatgtcatgtagcggtgaaatgcttagatatgacatagaacaccgattgcgaaggcggctcactacaggggtattgactctgaggcacgaaagcgtggggatcaaacagg

SEQ ID NO: 244 - DNA, 253 bp, Lacibacter cauensis
  Saprospirae; Chitinophagaceae; Lacibacter cauensis
tacggagggtgcaagcgttatccggattcactgggtttaaagggagcgtaggtggacttttaagtcagtggtgaaatctctgggcttaacccggaaactgccattgatactattagtcttgaattctctggaggtaagcggaatatgtcatgtagcggtgaaatgcttagatatgacatagaacacccattgcgaaggcagcttactacggagacattgacactgaggctcgaaagcgtggggatcaaacagg

SEQ ID NO: 245 - DNA, 253 bp, Lacibacter cauensis
  Saprospirae; Chitinophagaceae; Lacibacter cauensis
tacggagggtgcaagcgttatccggattcactgggtttaaagggtgcgtaggtggacagataagccagtggtgaaatctctgggcttaacccggaaactgccattgatactatttgtcctgaattctctggaggtaagcggaatatgtcatgtagcggtgaaatgcttagatatgacatagaacacccattgcgaaggcagcttaccacggagacattgacactgaggcacgaaagcgtggggatcaaacagg

SEQ ID NO: 246 - DNA, 253 bp, Lacibacter cauensis
  Saprospirae; Chitinophagaceae; Lacibacter cauensis
tacgaagggtgcaagcgttatccggattcactgggtttaaagggtgcgtaggtgggcagataaatcagtggtgaaatctctgggcttaacccggaaactgccattgatactatttgtcttgaattctctggaggtaagcggagtatgtcatgtagcggtgaagtgcttagatatgacatagaacacccattgcgaaggcagcttactacggagacattgacactgaggcacgaaagcgtggggatcaaacagg

SEQ ID NO: 247 - DNA, 253 bp, Niabella sp.
  Saprospirae; Chitinophagaceae; Niabella
aacggagggtgcaagcgttatccggattcactgggtttaaagggtgcgtaggtgggttggtaagtcagcggtgaaatctccgagcttaacttggaaactgccattgatactatcagtcttgaatattgtggaggttagcggaatatgtcatgtagcggtgaaatgcttagatatgacatagaacaccaattgcgaaggcagctggctacacatatattgacactgaggcacgaaagcgtggggatcaaacagg

SEQ ID NO: 248 - DNA, 253 bp, Niabella sp.
  Saprospirae; Chitinophagaceae; Niabella
tacggagggtgcaagcgttatccggattcactgggtttaaagggagcgtaggtgggctggtaagtcagtggtgaaatctccgagcttaacttggaaactgccattgatactattagtcttgaatattgtggaggtcagcggaatatgtcatgtagcggtgaaatgcttagagatgacatagaacaccaattgcgaaggcagctggctacgcatatattgacactgaggctcgaaagcgtggggatcaaacagg

SEQ ID NO: 249 - DNA, 253 bp, Niabella sp.
  Saprospirae; Chitinophagaceae; Niabella
tacggagggtgcaagcgttatccggattcactgggtttaaagggtgcgtaggtgggttggtaagtcagtggtgaaatctccgagcttaacttggaaactgccattgatactatcagtcttgaatattgtggaggttagcggaatatgtcatgtagcggtgaaatgcttagatatgacatagaacaccaattgcgaaggcagctggctacacatatattgacactgaggcacgaaagcgtggatagcgaatggg

SEQ ID NO: 250 - DNA, 253 bp, Niastella sp.
  Saprospirae; Chitinophagaceae; Niastella
tacggagggtgcaagcgttatccggattcactgggtttaaagggtgcgtaggtgggttggtaagtcagtggtgaaatctccgggcttaactcggaaactgccgttgatactatcaatcttgaatattgtggaggtaagcggaatatgtcatgtagcggtgaaatgcttagatatgacatagaacaccgatagcgaaggcagcttgctgcacaattattgacgctgaggcacgaaagcgtggggatcaaacagg

SEQ ID NO: 251 - DNA, 253 bp, Niastella sp.
  Saprospirae; Chitinophagaceae; Niastella
gacgaaggatgcgagcgttatccggattcactgggtttaaagggagcgtaggtgggatggtaagtcagtggtgaaatctccgggcttaactcggaaactgccgttgatactatcattcttgaatattgtggaggtaagcggaatatgtcatgtagcggtgaaatgcttagatatgacatagaacaccgatagcgaaggcagcttgctacacaattattgacactgaggctcgaaagcgtggggatcaaacagg

SEQ ID NO: 252 - DNA, 253 bp, Niastella sp.
  Saprospirae; Chitinophagaceae; Niastella
tacggagggtgcaagcgttatccggattcactgggtttaaagggagcgtaggtgggattgtaagtcagtggtgaaatcaccgggcttaactcggaaactgccgttgatactataattcttgagtattgtggaggtaagcggaatatgtcatgtagcggtgaaatgcttagatatgacatagaacaccgatagcgaaggcagcttgctacacaattattgacactgaggctcgaaagcgtggggatcaaacagg

SEQ ID NO: 253 - DNA, 253 bp, Niastella sp.
  Saprospirae; Chitinophagaceae; Niastella
tacagagggtgcgagcgttgttcggaattactgggcgtaaagcgcgtgtaggcggtctggaaagtcaggtgtgaaacctccgagcttaactcggaaactgccgtggatactattagtcttgaatctcgtggaggtaagcggaatatgtcatgtagcggtgaaatgcttagatatgacatagaacaccgatagcgaaggcagcttgctacacgagtatcgacactgaggcacgaaagcgtggggatcaaacagg

SEQ ID NO: 254 - DNA, 253 bp, Sediminibacterium sp.
  Saprospirae; Chitinophagaceae; Sediminibacterium
tacggagggtgcaagcgttatccggattcactgggtttaaagggtgcgtaggcgggcaggtaagtcagtggtgaaatcctggagctcaactccagaactgccattgatactatctgtcttgaatattgtggaggtaagcggaatatgtcatgtagcggtgaaatgcttagatatgacatagaacacctattgcgaaggcagcttactacgcatatattgacgctgaggcacgaaagcgtggggatcaaacagg

SEQ ID NO: 255 - DNA, 253 bp, Sediminibacterium sp.
  Saprospirae; Chitinophagaceae; Sediminibacterium
tacggagggtgcaagcgttatccggattcactgggtttaaagggtgcgtaggcgggtatgtaagtcagtggtgaaataccggagcttaacttcggaactgccattgatactatatatcttgaatattgtggaggtaagcggaatatgtcatgtagcggtgaaatgcttagagatgacatagaacaccgattgcgaaggcagcttgctacgcaaatattgacgctgaggcacgaaagcgtggggatcaaacagg

SEQ ID NO: 256 - DNA, 253 bp, Sediminibacterium sp.
  Saprospirae; Chitinophagaceae; Sediminibacterium
tacggagggtgcaagcgttatccggattcactgggtttaaagggtgcgtaggcgggtatttaagtcagtggtgaaatcctagagcttaactctagaactgccattgatactatttatcttgaatattgtggaggtaagcggaatatgtcatgtagcggtgaaatgcttagatatgacatagaacacctattgcgaaggcagcttactacgcatatattgacgctgaggcacgaaagcgtggggatcaaacagg

SEQ ID NO: 257 - DNA, 253 bp, Segetibacter sp.
  Saprospirae; Chitinophagaceae; Segetibacter
tacggagggtgcaagcgttatccggattcactgggtttaaagggtgcgtaggtgggttggtaagtcagtggtgaaatctccgtgcttaacatggaaactgccattgatactactggtcttgaattttctggaggtaagcggaatatgtcatgtagcggtgaaatgcttagatatgacatagaacaccaattgcgaaggcagcttactacagggatattgacactgaggcacgaaagcgtggggatcaaacagg

SEQ ID NO: 258 - DNA, 253 bp, Segetibacter sp.
  Saprospirae; Chitinophagaceae; Segetibacter
tacggagggtgcaagcgttatccggattcactgggtttaaagggtgcgtaggtgggaatgtaagtcagtggtgaaatctccgtgcttaacatggaaactgccattgatactatgtttcttgaattttctggaggtcagcggaatatgtcacgtagcggtgaaatgcttagatatgacatagaacaccaattgcgaaggcagctgactacagggatattgacactgaggcacgaaagcgtggggatcaaacagg

SEQ ID NO: 259 - DNA, 253 bp, Segetibacter sp.
  Saprospirae; Chitinophagaceae; Segetibacter
tacggagggtgcaagcgttatccggattcactgggtttaaagggtgcgtaggtgggttggtaagtcagtggtgagatctccgtgcttaacatggaaactgccattgatactactgatcttgaattatctggaggtaagcggaatatgtcatgtagcggtgaaatgcttagatatgacatagagcaccaattgcgaaggcagcttgctacaggttgattgacactgaggcacgaaagcgtggggatcaaacagg

SEQ ID NO: 260 - DNA, 253 bp, Segetibacter sp.
  Saprospirae; Chitinophagaceae; Segetibacter
tacgtagggtgcaagcgttatccggattcactgggtttaaagggtgcgtaggtgggtctgtaagtcagtggtgaaatctccgggcttaacccggaaactgccattgatactataggtcttgaatcttctggaggtcagcggaatatgtcatgtagcggtgaaatgcttagatatgacatagaataccaattgcgaaggcagctgactacaggggcattgacactgaggcacgaaagcgtggggatcaaacagg

SEQ ID NO: 261 - DNA, 254 bp, Unknown
  Description of Unknown: bacterium polynucleotide
  Saprospirae; Saprospiraceae
tacggagggtgcaagcgtcatccggaatcactgggtttaaagggtgcgtaggcggtggcgtaagtcagttgtgaaattccccggcttaaccggcgggactgcgattgatactgcgtcacttgaatcaggatgaggtaggcggaatgtgacatgtagcggtgaaatgcttagatatgtcatagaacaccgattgcgaaggcagcttgctggacctgtattgacgctgaggcacgaaagcgtggggagcaaacagg

SEQ ID NO: 262 - DNA, 253 bp, Unknown
  Description of Unknown: bacterium polynucleotide
  Saprospirae; Saprospiraceae
tacgtagggtgcgagcgttatccggaattactgggtttaaagggtgcgtaggcggctttgtaagtcaggagtgaaagtttgcggctcaaccgtaaaattgcttctgatactgcatggctagaattaggatgaggtcagcggaatgtggcatgtagcggtgaaatgcatagatatgccatagaacaccaattgcgaaggcagctggctagacctggattgacgctgaggcacgaaagcgtggggagcgaacagg

SEQ ID NO: 263 - DNA, 253 bp, Unknown
  Description of Unknown: bacterium polynucleotide
  Saprospirae; Saprospiraceae
tacggagggtgcgagcgttatccggaatcactgggtttaaagggtgcgtaggcggttatataagtcagtggtgaaaggccgtcgcttaacgatgggactgccattgatactgtataacttgagagaggttgaggttggcggaatgtggcatgtagcggtgaaatgcttagatataccatagaacaccaattgcgaaggcagctgactagacctcatctgacgctgaggcacgaaagcgtggggagcgaacagg

SEQ ID NO: 264 - DNA, 253 bp, Unknown
  Description of Unknown: bacterium polynucleotide
  Saprospirae; Saprospiraceae
tacggagggtgcgagcgttatccggaattactgggtttaaagggtgcgtaggcggccatgtaagtcaggagtgaaagtttgcggctcaaccgtaaaattgcttttgatactgcatggctggaatcaggatgaggtcagcggaatgtggcatgtagcggtgaaatgcatagatatgccatagaacaccaattgcgaaggcagatggctagacctgtattgacgctgaggcacgaaagcgtggggagcgaacagg

SEQ ID NO: 265 - DNA, 253 bp, Unknown
  Description of Unknown: bacterium polynucleotide
  Saprospirae; Saprospiraceae
tacggagagtgcgagcgttatccggaattactgggtttaaagggtgcgtaggcggccaagtaagtcaggagtgaaagtttgcggctcaaccgtaaaattgcttttgatactgcttagctagaattaggatgaggtcagcggaatgtggcatgtagcggtgaaatgcatagatatgccatagaacaccaattgcgaaggcagctggctagacctgtattgacgctgaggcacgaaagcgtggggatcgaacagg

SEQ ID NO: 266 - DNA, 254 bp, Unknown
  Description of Unknown: bacterium polynucleotide
  Saprospirae; Saprospiraceae
tacggagggtgcaagcgttatccggaatcactgggtttaaagggtgcgtaggcggtctaataagtcagtcgtgaaatcgctgggctcaacccatgcaattgcgattgatactgttagacttgaatggggttgaggctagcggaatgcggcatgtagcggtgaaatgcttagatatgccgcagaacaccgattgcgaaggcagctagctgggcctttattgacgctgaggcacgaaagcgtggggagcaaacagg

SEQ ID NO: 267 - DNA, 254 bp, Unknown
  Description of Unknown: bacterium polynucleotide
  Saprospirae; Saprospiraceae
tacggagggtgcaagcgttatccggaatcactgggtttaaagggtgcgtaggcggtctgataagtcagttgtgaaattcctcggcttaaccgagtggactgcgattgatactgtcagacttgaatcaggttgaggtaggcggaatgtgacatgtagcggtgaaatgcttagatatgtcatagaacaccgattgcgaaggcagcttgctgggcttcgattgacgctgaggcacgaaagcgtggggagcaaacagg

SEQ ID NO: 268 - DNA, 253 bp, Saprospira sp.
  Saprospirae; Saprospiraceae; Saprospira
tacggagggtgcaagcgttatccggaatcactgggtttaaagggtacgtaggcggcctgataagtcaggtgtgaaataccgcagcctaactgcggaactgcacttgatactgtccggcttgagtgaggtggaggtacacggaatgcatcatgtagcggtgaaatgcttagatatgatgtagaacaccgatagcgaaggcagtgtgccacacctatactgacgctgaggtacgaaagcgtggggagcgaacagg

SEQ ID NO: 269 - DNA, 253 bp, Unknown
  Description of Unknown: bacterium polynucleotide
  Spartobacteria; Chthoniobacteraceae
tacagaggtcccgagcgttgttcggattcattgggcgtaaagggtgcgtaggcggcgccgtaagtcaggtgtgaaagcttggggcttaaccccaaaagagcatttgaaactgcggtgctagagtactggagaggagactggaattcacggtgtagcagtgaaatgcgtagatatcgtgaggaaggccagtggcgaaagcgggtctctggacaggtactgacgctgaggcacgaaggctaggggagcaaacggg

SEQ ID NO: 270 - DNA, 253 bp, Unknown
  Description of Unknown: bacterium polynucleotide
  Spartobacteria; Chthoniobacteraceae
tacagaggtcccaaccgttgttcggattcattgggcgtaaagggtgcgtaggcggtcgcgcaagtcggatgtgaaatctcggggctcaaccccgaaactgcattcgatactgcgtggctagagtgctggagaggagactggaatttacggtgtagcagtgaaatgcgtagatatcgtaaggaagaccagtggcgaaggcgagtctctggacagcaactgacgctgaggcacgaaggccaggggagcaaacggg

SEQ ID NO: 271 - DNA, 253 bp, Unknown
  Description of Unknown: bacterium polynucleotide
  Spartobacteria; Chthoniobacteraceae
tacgtagggtgcaagcgttaatcggaattactgggcgtaaagggtgcgtaggcggcgccgttagtcggatgtgaaatcttggggctcaaccccgaaattgcattcgatactgcggtgctagaggactctagaggaaactggaattcacggtgtagcagtgaaatgcgtagatatcgtgaggaagaccagtggcgaaggcgggtttctggagagttcctgacgctgaggcacgaaggccaggggagcaaacggg

SEQ ID NO: 272 - DNA, 253 bp, Unknown
  Description of Unknown: bacterium polynucleotide
  Spartobacteria; Chthoniobacteraceae
tacagaggtctcaagcgttgttcggattcattaggcgtaaagggtgcgtaggtggcggggcaagtttggtgtgaaatcccggggctcaacctcggaactgcactgaatactgccttgctagagcactggagagggaactggaatttacggtgtagcagtgaaatgcgtagatatcgtaaggaagaccagtggcgaaggcgagttcctggacagttgctgacactgaggcacgaaggctaggggagcaaacggg

SEQ ID NO: 273 - DNA, 253 bp, Unknown
  Description of Unknown: bacterium polynucleotide
  Spartobacteria; Chthoniobacteraceae
tacagaggtctcaaccgttgttcggattcattgggcgtaaagggtgcgtaggcggtcgtgtaagtcggatgtgaaatctcagggctcaaccctgaaactgcattcgatactgcatggctagggtactggagaggagactggaatttacggtgtagcagtgaaatgcgtagatatcgtaaggaagaccagtggcgaaggcgagtctctggacagttaccgacgctgaggcacgaaggtcgggggagcaaacggg

SEQ ID NO: 274 - DNA, 253 bp, Unknown
  Description of Unknown: bacterium polynucleotide
  Spartobacteria; Chthoniobacteraceae
tacagaggtctcaagcgttgttcggattcattgggcgtaaagggtgcgtaggcggtagggtaagtctggtgtgaaatcccggggctcaaccccggaactgcactggatactgctttactagagcactggagagggaactggaatttacggtgtagcagtgaaatgcgtagatatcgtaaggaagaccagtggcgaaggcgagttcctggacagttgctgacgctgaggcacgaaggccaggggagcaaacggg

SEQ ID NO: 275 - DNA, 253 bp, Unknown
  Description of Unknown: bacterium polynucleotide
  Spartobacteria; Chthoniobacteraceae
tacagaggtctcgagcgttgttcggattcattgggcgtaaagggtgcgtaggtggtctggtaagtcggatgtgaaatcccggagcttaacttcggaactgcattcgatactgccggactggagtactggagaggagatcggaatttacggtgtagcagtgaaatgcgtagatatcgtaaggaagaccagtggcgaaggcggatctctggacagttactgacactgaggcacgaaggccaggggagcaaacggg

SEQ ID NO: 276 - DNA, 253 bp, Unknown
  Description of Unknown: bacterium polynucleotide
  Spartobacteria; Chthoniobacteraceae
tacagaggtctcaaccgttgttcggattcattgggcgtaaagggtgcgtaggcggtcgcgtaagtcaggtgtgaaatctcggggctcaaccccgaaactgcacttgatactgcgtggctcgggtactggagaggagactggaatttacggtgtagcagtgaaatgcgtagatatcgtaaggaagaccagtggcgaaggcgagtctctggacagttaccgacgctgaggcacgaaggtcaggggagcaaacggg

SEQ ID NO: 277 - DNA, 253 bp, Unknown
  Description of Unknown: bacterium polynucleotide
  Spartobacteria; Chthoniobacteraceae
tacagaggtcccaaccgttgttcggatttattgggcgtaaagggtgcgtaggcggtcgcgcaagtcggatgtgaaatcccagggctcaaccctgaaactgcattcgatactgcgtggctcgagtactggagaggagactggaatttacggtgtagcagtgaaatgcgtagatatcgtaaggaagaccagtggcgaaggcgagtctctggacagttactgacgctgaggcacgaaggccaggggagcaaacggg

SEQ ID NO: 278 - DNA, 253 bp, Unknown
  Description of Unknown: bacterium polynucleotide
  Spartobacteria; Chthoniobacteraceae
tacagaggtctcaaccgttgttcggattcattgggcgtaaagggtgcgtaggcggcggggtaagtcaggtgtgaaatctcggggctcaaccccgaaactgcacttgatactgcctcgcttgagtactggagaggagactggaatttacggtgtagcagtgaaatgcgtagatatcgtaaggaagaccagtggcgaaggcgagtctctggacagttactgacgctgaggcacgaaggccaggggagcaaacggg

SEQ ID NO: 279 - DNA, 253 bp, Unknown
  Description of Unknown: bacterium polynucleotide
  Spartobacteria; Chthoniobacteraceae
tacagaggtctcaagcgttgttcggattcattgggcgtaaagggtgcgtaggtggcaaggtaagtcgggtgtgaaatcccggggctcaaccctggaactgcactcgatactgccatgctcgagtactggagaggagactggaatttacggtgtagcagtgaaatgcgtagatatcgtaaggaagaccagtggcgaaggcgagtctctggacagttactgacactgaggcacgagggccaggggagcaaacggg

SEQ ID NO: 280 - DNA, 253 bp, Candidatus xiphinematobacter
  Spartobacteria; Chthoniobacteraceae; Candidatus Xiphinematobacter
tacagaggtctcaagcgttgttcggattcattgggcgtaaagggcgcgtaggcggtggggtaagtctggtgtgaaatctcggagctcaacttcgaaattgcactggatactgctctgctagagggctggagaggagatcggaattcacggtgtagcagtgaaatgcgtagatatcgtgaggaagaccagtggcgaaggcggatctctggacagctcctgacgctgaggcgcgaaggctaggggagcaaacggg

SEQ ID NO: 281 - DNA, 253 bp, Candidatus xiphinematobacter
  Spartobacteria; Chthoniobacteraceae; Candidatus Xiphinematobacter
tacagaggtctcaagcgttgttcggattcattgggcgtaaagggcgcgtaggctgcggggcaagtcgggtgtgaaatctcagagctcaactctgaaactgcactcgatactgctctgctcgaggactggagaggagactggaattcacggtgtagcagtgaaacgcgtagagatcgtgaggaagaccagtggcgaaggcgggtctctggacagttcctgacgctgaggcgcgaaggccaggggagcaaacggg

SEQ ID NO: 282 - DNA, 253 bp, Candidatus xiphinematobacter
  Spartobacteria; Chthoniobacteraceae; Candidatus Xiphinematobacter
tacagaggtctcaagcgttgttcggattcattgggcgtaaagggtgcgtaggtggtcatgtaagtctaatgtgaaatctcggggctcaaccccgaaattgcatcggatactgcgtgactagaggactgtagaggagattggaattcacggtgtagcagtgaaatgcgtagatatcgtgaggaagaccagttgcgaaggcgaatctctgggcagttcctgacactgaggcacgaaggccaggggagcaaacggg

SEQ ID NO: 283 - DNA, 253 bp, Candidatus xiphinematobacter
  Spartobacteria; Chthoniobacteraceae; Candidatus Xiphinematobacter
tacagaggcctcaagcgttgttcggattcattgggcgtaaagggtgcgtaggtggcttggtaagttgaaggtgaaatctcggggcttaactccgaaactgccttcaatactgctgagctcgaggattgtagaggagaatggaattcacggtgtagcagtgaaatgcgtagatatcgtgaggaagaccagtggcgaaggcgattctctgggcaattcctgacactgaggcacgaaggctaggggagcaaacggg

SEQ ID NO: 284 - DNA, 253 bp, Candidatus xiphinematobacter
  Spartobacteria; Chthoniobacteraceae; Candidatus Xiphinematobacter
tacagaggtctcaagcgttgttcggattcattgggcgtaaagggtgcgcaggcggcgtggtaagttgagtgtgaaatctcggggctcaaccccgaaactgcactcaatactgccatgctcgaggactgtagaggagagtggaattcacggtgtagcagtgaaatgcgtagatatcgtgaggaagaccagttgcgaaggcgactctctgggcagttcctgacgctcatgcacgaaggccaggggagcaaacggg

SEQ ID NO: 285 - DNA, 253 bp, Candidatus xiphinematobacter
  Spartobacteria; Chthoniobacteraceae; Candidatus Xiphinematobacter
tacagaggtctcaagcgttgttcggattcattgggcgtaaagggtgcgtaggtggtggcgccagtctggtgtgaaatctcggagctcaactccgaaattgcaccggatactgcgtgacttgaggactgtagaggagatcggaattcacggtgtagcagtgaaatgcgtagatatcgtgaggaagaccagttgcgaaggcggatctctgggcagttcctgacactgaggcacgaaggccaggggagcaaacggg

SEQ ID NO: 286 - DNA, 253 bp, Candidatus xiphinematobacter
  Spartobacteria; Chthoniobacteraceae; Candidatus Xiphinematobacter
tacagaggtctcaagcgttgttcggatttattgggcgtaaagggtgcgcaggcggtgtggtaagtctggtgtgaaatcctggggctcaaccccagaaatgcactggatattgccatgctagaggactggagaggagattggaattcacggtgtagcagtgaaatgcgtagatatcgtgaggaagaccagtggcgaaggcgaatctctggacagttcctgacgctcatgcacgaaggctaggggagcaaacggg

SEQ ID NO: 287 - DNA, 253 bp, Chthoniobacter sp.
  Spartobacteria; Chthoniobacteraceae; Chthoniobacter
tacagaggtctcaagcgttgttcggattcattgggcgtaaagggtgcgtaggtggcggggtaagtcaggtgtgaaatctcggagctcaactccgaaactgcacttgatactgccttgctcgagtactggagaggagattggaatttacggtgtagcagtgaaatgcgtagatatcgtaaggaagaccagtggcgaaggcgaatctctggacagttactgacactgaggcacgaaggccaggggagcaaacggg

SEQ ID NO: 288 - DNA, 253 bp, Chthoniobacter sp.
  Spartobacteria; Chthoniobacteraceae; Chthoniobacter
tacagaggtcccgagcgttgttcggattcattgggcgtaaagggtgcgtaggtggcaccgtaagtcaggtgtgaaatctcggggcttaaccccgaaactgcacttgatactgcggtgctcgagtactggagaggagattggaatttacggtgtagcagtgaaatgcgtagatgtcgcaaggaagaccagtggcgaaggcgaatctctggacagttactgacactgaggcacgaaggccaggggagcaaacggg

SEQ ID NO: 289 - DNA, 253 bp, Unknown
  Description of Unknown: bacterium polynucleotide
  Spartobacteria; Chthoniobacteraceae; DA101
tacagaggtctcaagcgttgttcggattcattgggcgtaaagggtgcgtaggcggcgcggtaagtcgggtgtgaaatctcggagcttaactccgaaactgcattcgatactgccgtgcttgaggactggagaggagactggaatttacggtgtagcggtgaaatgcgtaggtatcgtaaggaagaccagtggcgaaggggggtctctggacagttcctgacgctgaggcacgaaggcctggggagcaaacagg

SEQ ID NO: 290 - DNA, 253 bp, Unknown
  Description of Unknown: bacterium polynucleotide
  Spartobacteria; Chthoniobacteraceae; DA101
tacagaggtctcaagcgttgttcggattcattgggcgtaaagggtgtgtaggtggcgcgctaagtcgggtgtgaaatttcggagcttaactccgaaactgcattcgatactggcgtgcttgaggactggagaggagactggaattcatggtgtagcagtgaaatgcgtagagatcatgaggaagaccagtggcgaaggcgggtctctggacagttcctgacactgagacacgaaggccaggggagcaaacggg

SEQ ID NO: 291 - DNA, 253 bp, Unknown
  Description of Unknown: bacterium polynucleotide
  Spartobacteria; Chthoniobacteraceae; DA101
tacagaggtctcaagcgttgctcggattcattgggcgtaaagggtgcgtaggtggcgctgtaagtcgggtgtgaaatttcggagctcaactccgaaactgcattcgatactgcggtgcttgaggactggagaggagactggaattcatggtgtagcagtgaaatgcgtagagatcatgaggaagaccagtggcgaaggcgggtctctggacagttcccgacactgaggcacgaaggccaggggagcaaacggg

SEQ ID NO: 292 - DNA, 253 bp, Unknown
  Description of Unknown: bacterium polynucleotide
  Spartobacteria; Chthoniobacteraceae; DA101
tacagaggtctcaagcgttgttcggattcattgggcgtaaagggtgcgtaggtggcgcgctaagtcgggtgtgaaatttcggagcttaactccgaaactgcattcgatactggcgtgcttgaggactggagaggagactggaatttacggtgtagcggtgaaatgcgtagatatcgtaaggaagaccagtggcgaaggcgggtctctggacagttcctgacgctgaggcacgaaggccaggggagcaaacggg

SEQ ID NO: 293 - DNA, 253 bp, Unknown
  Description of Unknown: bacterium polynucleotide
  Spartobacteria; Chthoniobacteraceae; DA101
tacagaggtctcaagcgttgttcggattcattgggcgtaaagggtgcgtaggtggcgccataagtcgggtgtgaaatctcggggcttaactccgaaactgcattcgatactgtggtgcttgaggactggagaggagactggaattcatggtgtagcagtgaaatgcgtagagatcatgaggaagaccagtggcgaaggcgggtctctggacagttcctgacactgaggcacgaaggccaggggagcaaacggg

SEQ ID NO: 294 - DNA, 253 bp, Unknown
  Description of Unknown: bacterium polynucleotide
  Spartobacteria; Chthoniobacteraceae; DA101
tacagaggtctcaagcgttgttcggattcattgggcgtaaagggtgcgtaggtggcgcgttaagtcaggtgtgaaatttcggagcttaactccgaaactgcatttgatactggcgtgcttgaggactggagaggagactggaattcacggtgtagcagtgaaatgcgtagatatcgtgaggaagaccagtggcgaaggcgggtctctggacagttcctgacactgaggcacgaaggccaggggagcgaacggg

SEQ ID NO: 295 - DNA, 253 bp, Unknown
  Description of Unknown: bacterium polynucleotide
  Spartobacteria; Chthoniobacteraceae; DA101
tacagaggtcccaagcgttgttcggattcattgggcgtaaagggtgcgtaggtggcgccgtaagtggggtgtgaaacttcggagcttaactccgaaactgcattccatactgcggtgcttgaggactggagaggagactggaattcatggtgtagcagtgaaatgcgtagagatcatgaggaagaccagtggcgaaggcgggtctctggacagttcctgacactgaggcacgaaggctaggggagcgaacggg

SEQ ID NO: 296 - DNA, 253 bp, Unknown
  Description of Unknown: bacterium polynucleotide
  Spartobacteria; Chthoniobacteraceae; DA101
tacagaggtcccaagcgttgttcggattcattgggcgtaaagggtgcgtaggtggcgtcgtaagtcgggtgtgaaatctcggggcttaactccgaaactgcattcgatactgcggtgcttgaggactggagaggagactggaatttacggtgtagcagtgaaatgcgtagagatcgtaaggaagaccagtggcgaaggcgggtctctggacagttcctgacactgaggcacgaaggccaggggagcaaacggg

SEQ ID NO: 297 - DNA, 253 bp, Unknown
  Description of Unknown: bacterium polynucleotide
  Spartobacteria; Chthoniobacteraceae; Ellin506
tacagaggtcccgagcgttgttcggattcattgggcgtaaagggtgcgtaggcggcggggcaagtctggtgtgaaatcccggggctcaaccccggaactgcactggatactgccttgctagagtactggagagggaactggaatttacggtgtagcagtgaaatgcgtagagatcgtaaggaagaccagtggcgaaggcgagttcctggacagtaactgacgctgaggcacgaaggccaggggagcaaacggg

SEQ ID NO: 298 - DNA, 253 bp, Unknown
  Description of Unknown: bacterium polynucleotide
  Spartobacteria; Chthoniobacteraceae; Ellin506
tacagaggtcccgagcgttgttcggattcattgggcgtaaagggtgcgtaggcggtcttctaagtttgatgtgaaatcccggggcttaaccctggaatggcattgaatactggaggactagagtactggagaggaaactggaatttacggtgtagcagtgaaatgcgcagatatcgggaagaacacccgtggcgaaggcggctctctgggacggtactgacgctgagacgcgaaagcgtggggagcaaacagg

SEQ ID NO: 299 - DNA, 253 bp, Unknown
  Description of Unknown: bacterium polynucleotide
  Spartobacteria; Chthoniobacteraceae; OR-59
tacagaggtcccaagcgttgttcggatttattgggcgtaaagggtgcgtaggcggcggagtaagttgggtgtgaaatcccggggctcaacctcggaattgcattcaatactgcttcgctcgagtactggagaggaggctggaatttacggtgtagcagtgaaatgcgtagatatcgtaaggaaggccggtggcgaaagcgagcctctggacagttactgacgctgatgcacgaaggccaggggagcaaacggg

SEQ ID NO: 300 - DNA, 253 bp, Unknown
  Description of Unknown: bacterium polynucleotide
  Spartobacteria; Chthoniobacteraceae; OR-59
tacagaggtcccaagcgttgttcggatttattgggcgtaaagggtgcgtaggcggcagtgtaagttggacgtgaaatcctggggcttaacctcagaattgcgttcaatactgcattgctagggcgctgtagaggagattggaatttacggtgtagcagtgaaatgcgtagatatcgtaaggaagaccagtggcgaaagcgaatctctgggcagcagccgacgctgaggcacgaaggccaggggagcaaacggg

SEQ ID NO: 301 - DNA, 253 bp, Unknown
  Description of Unknown: bacterium polynucleotide
  Spartobacteria; Chthoniobacteraceae; OR-59
tacagaggtcccaagcgttgttcggattcattgggcgtaaagggtgcgtaggcggtagggtaagttggatgtgaaatcttggggcttaacctcaaaattgcattcaatactgccttgctcgagttctgtagaggagattggaatttacggtgtagcagtgaaatgcgtagatatcgtaaggaacgccagtggcgaaagcgaatctctgggcagcaactgacgctgaggcacgaaggccaggggagcaaacggg

SEQ ID NO: 302 - DNA, 253 bp, Thermobaculum sp.
  Thermobacula; Thermobaculaceae; Thermobaculum
tacgtagggggcaagcgttgtccggatttattgggcgtaaagagcgcgcaggcggtccaataagtcactcgtgaaatccctcggctcaaccgaggaaagttgggtgatactgttggactagagggcggaagaggaaagtggaattcccggtgtagtggtgaaatgcgtagatatcgggaggaacaccagtggcgaaggcggctttctggtccgcaactgacgctgaggcgcgaaggctaggggagcgaacggg

SEQ ID NO: 303 - DNA, 253 bp, Unknown
  Description of Unknown: bacterium polynucleotide
  028H05-P-BN-P5
tacggtgtgtgcaagcgttactcggaatcactgggcataaagagcacgtaggtgggctcgccagtcggatgtgaaatcccccagctcgactggggaactgcatccgatactgcgggtcttgaggacgaaaggggagagtggaacttctggtggagcggtgaaatacgtagatatcagaaggaacaccggtggcgaaggcgactctctggttcgtttctgacactgaggtgcgaaagcgtgggtagcaaacggg

SEQ ID NO: 304 - DNA, 253 bp, Unknown
  Description of Unknown: bacterium polynucleotide
  0319-6E2
tacgtagggggcaagcgttgtccggaattactgggcgtaaagcgcgtgtaggcgggacggtaagtcggacgtgaaaggcgcgggctcaacccgcgagcgccgttcgaaactgccgttcttgagggtcgaagaggagagtggaattcctggtgtagcggtgaaatgcgtagagatcaggaggaacacccgtggcgaaggcggctctctggtcggcctctgacgctgagacgcgaaagcgtggggagcgaacggg

SEQ ID NO: 305 - DNA, 253 bp, Unknown
  Description of Unknown: bacterium polynucleotide
  0319-6E2
tacgtagggggcaagcgttgtccggatttactgggcgtaaagcgcgcgtaggcggaggcttaagcgtggcctgaaagcccccggctcaaccggggagggcggctgcgaactgggtctcttgagggcgatagaggggggcggaattcctggtgtagcggtgaaatgcgtagagatcaggaggaacacccgtggcgaaggcggccccctgggtcggccctgacgctgaggcgcgaaagcgtggggagcgaacagg

SEQ ID NO: 306 - DNA, 253 bp, Unknown
  Description of Unknown: bacterium polynucleotide
  0319-6E2
tacgtagggggcgagcgttgtccggatttactgggcgtaaagcgcgtgtaggcggtcccttaagtccggggtgaaaggcggaggctcaacctccgagctgcgccggaaactgggggtcttgagtgtcggagaggggcgtggaattcctggtgtagcggtgaaatgcgtagagatcaggaggaacaccggtggcgaaggcggcgccctggccgaacactgacgctgagacgcgaaagtgcggggagcgaacagg

SEQ ID NO: 307 - DNA, 253 bp, Unknown
  Description of Unknown: bacterium polynucleotide
  0319-6E2
tacgtagggggcaagcgttgtccggatttactgggcgtaaagagcgcgtaggcggaaatttaagcgtggcctgaaagcccccggctcaaccggggagtgcggctgcgaactgggtttcttgaggacgatagaggagagtggaattcctggtgtagcggcgaaatgcgtagatatcaggaggaacacccgaggcgaaggcggctctctgggtcgtacctgacgctgaggcgcgaaagcgtggggagcgaacggg

SEQ ID NO: 308 - DNA, 253 bp, Unknown
  Description of Unknown: bacterium polynucleotide
  0319-6E2
tacgtagggggcaagcgttgtctggatttactgggcgtaaagagcgcgtaggcggatgtttaagtgtggcctgaaagcccccggctcaaccggggatccgggttgcatactggacatcttgagggggataggggaaggtggaattcctggtgtagcggtgaaatgcgtagagatcaggaggaacacccgtggcgaaggcggccttctgggtccgccctgacgctgaggcgcgaaagcgtggggagcgaacggg

SEQ ID NO: 309 - DNA, 253 bp, Unknown
  Description of Unknown: bacterium polynucleotide
  4C0d-2
gacgtagggtgcgagcgttgtccggatttattgggcgtaaagagttcgtaggcggttgcctaagtctggtgttaaatactggcgctcaacgccagcatggcattggaaactgggcagctagagtgtggtagaggtcacgggaattcctggtgtagcggtgaaatgcgtagatatcaggaggaacaccggtggcgaaagcgcgtgactgggccacaactgacgctgaggaacgaaagccagggtagcaaaaggg

SEQ ID NO: 310 - DNA, 253 bp, Unknown
  Description of Unknown: bacterium polynucleotide
  4C0d-2
tacggagggtgcaagcattaatcggatttattgggcgtaaagagttcgtaggcggtttgttaagtctgatgttaaagatcagggcccaaccctgggagtgcattggatactggcagactggagtgtggtagaggtaagtggaattcctggtgtagcggtgaaatgcgtagatatcaggaagaacaccggtggcgtaggcgacctactgggccataactgacgctgaggaacgaaagccaggggagcaaatggg

SEQ ID NO: 311 - DNA, 253 bp, Unknown
  Description of Unknown: bacterium polynucleotide
  4C0d-2
gacgtaggatgcgagcgttgtccggatttattgggcgtaaagagttcgtaggtggtttgttaagtctgatgttaaagattggggctcaaccctgaaaatgcattggatactggcagacttgagtgtggtagaggctagtggaattcccagtgtagcggtgaaatgcgtagatattgggaagaacaccggtggcgtaggcgactagctgggccataactgacactgaggaacgaaagccagggtagcgaatggg

SEQ ID NO: 312 - DNA, 253 bp, Unknown
  Description of Unknown: bacterium polynucleotide
  4C0d-2
gacgtaggatgcaagcgttgtccggatttattgggcgtaaagagttcgtaggtggtttgttaagtctgatgttaaagactggggctcaacctcgggactgcattggatactggcagacttgagtgcggtagaggcaagtggaattccaggtgtagcggtgaaatgcgtagatatctggaagaacaccggtggcgcaagcgacttgctgggccgtaactgacactgaggaacgaaagctaggggagcgaatggg

SEQ ID NO: 313 - DNA, 253 bp, Unknown
  Description of Unknown: bacterium polynucleotide
  4C0d-2
gacgtaggatgcaagcgttgtccggaattattgggcgtaaagagttcgtaggcggttgcctaagtctgatgttaaatactggagctcaactccggcatggcattggaaactgggtggctagagtgtggtagaggtctcgggaattccaggtgtagcggtgaaatgcgtagatatctggaggaacaccggtggcgaaagcgcgagactgggccataactgacgctgaggaacgaaagccaggggagcgaaaggg

SEQ ID NO: 314 - DNA, 253 bp, Unknown
  Description of Unknown: bacterium polynucleotide
  4C0d-2
gacgtaggatgcgagcgttgtccggatttattgggcgtaaagagttcgtaggtggttcactaagtttggtgtaaaagacgggggctcaaccctcggatcgcactgaatactggtggactggagtggagtagaggcaagcggaattcccagtgtagcggtgaaatgcgtagatattgggaagaacaccggtggcgtaagcggcttgctgggctttaactgacactgaggaacgaaagctaggggagcgaatggg

SEQ ID NO: 315 - DNA, 254 bp, Unknown
  Description of Unknown: bacterium polynucleotide
  ABS-6
tacgtagggggctagcgttatccagatttactgggcgtaaagcgcgtgtaggcggctggttaggtgtgatgtgaaatccttgggctcaacccgagaactgcattgcaaaccggcctggctagagtgcaggagagggaagcggaattccaggtgtagcggtgaaatgcgtagatatctggaggaacaccagtggcgaaggcggcttcctggcctgtaactgacgctgagacgcgaaagcgtggggagcgaaccgg

SEQ ID NO: 316 - DNA, 253 bp, Unknown
  Description of Unknown: bacterium polynucleotide
  ABY1
tacgagtaccccaagcgttatccggatttattgggcgtaaagcgttcgtaggcggcttgtcgcatctcttgttaaatcccaaggctcaaccttggggccgcaggagacatggataagctagagactggaagaggcaagcggaattgctggtgtaggggttaaatccgttaatatcagcaggaacaccaaaagcgaaggcagcttgctagaacagttctgacgctcaggaacgaaagcgtggggagcgaatggg

SEQ ID NO: 317 - DNA, 254 bp, Unknown
  Description of Unknown: bacterium polynucleotide
  Acidimicrobiia
tacgtagggtgcaagcgttgtccggatttattgggcgtaaagagctcgtaggcggcttagaaagtcaggtgtgaaacctccaggctcaacctggagacgccacttgatacttctatggcttgagttcggtaggggaccatggcattcctggtgtagcggtgaaatgcgcagatatcaggaggaacaccgatggcgaaggcagtggtctgggccgatactgacgctgaggagcgaaagcgtggggagcgaacagg

SEQ ID NO: 318 - DNA, 254 bp, Unknown
  Description of Unknown: bacterium polynucleotide
  Acidimicrobiia
cacgtagggtgcaagcgttgtccggattcattgggcgtaaagggctagtaggcggcttagcaagtcgggtgtgaaatctccaggctcaacctggaatcgccatccgatactgctatggcttgagtccggtaggggaccacggaattcctggtgtagcggtgaaatgcgcagatatcaggaggaacaccgatggcgaaggcagtggtctgggccggcactgacgctgaatagcgaaagcgtgggtagcgaacagg

SEQ ID NO: 319 - DNA, 254 bp, Unknown
  Description of Unknown: bacterium polynucleotide
  Acidimicrobiia
cacgtagggggcgagcgttgtccggatttattgggcgtaaagagctcgtaggcggttcgctaagtcgggtgtgaaacctccaggctcaacctggagacgccacctgatactggtgtgactagagtccggtaggggagtgtggaactcctggtgtagcggtgaaatgcgcagatatcaggaagaacaccagcggcgagggcggcactctgggccggtactgacgctgaggagcgaaagcgtgggtagcaaacagg

SEQ ID NO: 320 - DNA, 254 bp, Unknown
  Description of Unknown: bacterium polynucleotide
  Acidimicrobiia
cacgtagggggcaagcgttgtccggatttattgggcgtaaagagctcgtaggtggttcggtaagtcaggtgtgaaacctccaggctcaacctggagacgccacttgatactgctgtgactggagtccggtaggggagcgtggaattcctggtgtagcggtgaaatgcgcagatatcaggaggaacaccagcggcgaaggcggcgctctgggccggtactgacactgaggagcgaaagcgtgggtagcaaacagc

SEQ ID NO: 321 - DNA, 254 bp, Unknown
  Description of Unknown: bacterium polynucleotide
  Acidimicrobiia
tacgtagggggcaagcgttgtccggatttattgggcgtaaagagctcgtaggcggcttggcgagtcgggtgtgaaaacttcaggctcaacctggagcggccactcgatactgctatggcttgagtccggtaggggaccacggaattcctggtgtagcggtgaaatgcgtagaggtcgggaggaacaccagtggcgaaggcggccggctgggggtgacctgacgctgaggcgcgaaagcgtggggagcgaaccgg

SEQ ID NO: 322 - DNA, 253 bp, Unknown
  Description of Unknown: bacterium polynucleotide
  Acidimicrobiia
tacgtagggtccaagcgttgtccggatttattgggcgtaaagagctcgtaggcggctcagtaagtcggatgtgaatactcggggctcaaccccgagacgccatccgatactgctgtggcttgagtctggtaggggaacacggaattcctggtgtagcggtgaaatgcgcagatatcaggaggaacaccgatggcgaaggcagtgttctggccagtactgacgctgaggagcgaaagcgtgggtagcaaacagg

SEQ ID NO: 323 - DNA, 254 bp, Unknown
  Description of Unknown: bacterium polynucleotide
  Acidimicrobiia
cacgtagggggcgagcgttgtccggatttattgggcgtaaagagctcgtaggcggtttcgtaagtcggatgtgaaaactccaggctcaacttggagacgccattcgatactgcgatgacttgagtccggtaggggagtgtggaattcctggtgtagcggtgaaatgcgcagatatcaggaggaacaccggcggcgaaggcggcactctgggccggtactgacgctgaggagcgaaagcgtgggtagcaaacagg

SEQ ID NO: 324 - DNA, 254 bp, Unknown
  Description of Unknown: bacterium polynucleotide
  Acidimicrobiia
cacgtagggggcaagcgttgtccggatttattgggcgtaaagagctcgtaggtggttcggtaagtcgggtgtgaaaactctgggctcaactcagagacgccacccgatactgctgtgacttgagtctggtaggggagtgtggaattcccagtgtagcggtgaaatgcgcagatattgggaggaacaccagtggcgaaggcggcactctgggccagaactgacactgaggagcgaaagcgtgggtagcgaacagg

SEQ ID NO: 325 - DNA, 253 bp, Unknown
  Description of Unknown: bacterium polynucleotide
  Acidimicrobiia
cacgtagggggcaagcgttgtccggatttattgggcgtaaagagctcgtaggtggctgagtaagtcggatgttaaatccccaggctcaacctgggacaccacccgatactgctctggctagagtccggtaggggagcgtggaattcctggtgtagcggtgaaatgcgcagatatcaggaggaacaccagcggcgaaggcggcgctctgggccggtactgacactgaggagcgaaagcgtgggtagcaaacagg

SEQ ID NO: 326 - DNA, 254 bp, Unknown
  Description of Unknown: bacterium polynucleotide
  Acidimicrobiia
tacgtagggggcgagcgttgtccggattcattgggcgtaaagcgctttaaggcggttcgctaagtcgggtgtgtaacctccaggctcaacctggagacgccactcgatactggcgcgactagagttcggtaggggaccacggaattcctggtgtagcggtgaaatgcgcagatatcaggaggaacaccagtggcgaaggcggtggtctgggccgatactgacgctgtagagcgaaagcgtggggagcgaacagg

SEQ ID NO: 327 - DNA, 253 bp, Unknown
  Description of Unknown: bacterium polynucleotide
  Acidimicrobiia
tacgtagggggcaagcgttgtccggatttattgggcgtaaagagctcgtaggcggttccgtaagtcgagtgtgaaaaatctgggctcaacccagtggagcactcgatactgcggtgactagagtacggtagaggagtgtggaatttgtagtgtagcggcgaaatgcgcagatattacaaggaacaccaacggcgaaggcagcactctgggccggtactgacgctgaggagcgaaagcgtgggtagcaaacagg

SEQ ID NO: 328 - DNA, 254 bp, Unknown
  Description of Unknown: bacterium polynucleotide
  Acidimicrobiia
tacgtagggggcgagcgttgtccggatttattgggcgtaaagagctcgtaggcggcttggcaagtcgggtgtgaaacctccaggctcaacctggagacgccactcgatactgctatggctagagtccggtaggggaccacggaattcctggtgtagcggtgaaatgcgcagatatcaggaggaacaccggtggcgaaggcggtggtctgggccggcactgacgctgaggagcgaaagcgtgggtagcaaacagg

SEQ ID NO: 329 - DNA, 254 bp, Unknown
  Description of Unknown: bacterium polynucleotide
  Acidimicrobiia
tacgtagggagcaagcgttgtccggatttattgggcgtaaagagctcgtaggcggctaagtaagtcaggtgtgaaacctccaggctcaacctggagacgccacttgatactgctttggcttgagttcggtaggggtaagcggaattcctggtgtagcggtgaaatgcgcagatatcaggaggaacaccgatggcgaaggcagcttactgggccgatactgacgctgaggagcgaaagcgtggggagcgaacagg

SEQ ID NO: 330 - DNA, 254 bp, Unknown
  Description of Unknown: bacterium polynucleotide
  Acidimicrobiia
tacgtagggagcgagcgttgtccggatttattgggcgtaaagagcgcgtaggcggcttggtaagccggatgtgaaacccccaagctcaacttggggcggccattcggaactgccatggctagagtctggtaggggaacacggaattcctggtgtagcggtgaaatgcttagatatcaggaggaacaccagtggcgaaggcggtgttctgggccagtactgacgctgaggcgcgaaagcgtggggagcgaacagg

SEQ ID NO: 331 - DNA, 254 bp, Unknown
  Description of Unknown: bacterium polynucleotide
  Acidimicrobiia
cacgtagggggcgagcgttgtccggatttattgggcgtaaagagctcgtaggcggtttcgttagtcgggtgtgaaaaccccaggctcaacctggggacgccacccgatactgcgatgactagagtccggtaggggagtgtggaattcctggtgtagcggtgaaatgcgcagatatcaggaggaacaccaacggcgaaggcagcactctgggccggaactgacgctgaggagcgaaagcgtgggtagcgaacagg

SEQ ID NO: 332 - DNA, 254 bp, Unknown
  Description of Unknown: bacterium polynucleotide
  Acidimicrobiia; C111
cacgtaggcaccaagcgttgtccggatttattgggcgtaaagagctcgtaggcggttcggtaagtcgggtgtgaaaactcagggctcaaccctgagccgccacccgatactgctgtgacttgagttcggtaggggagcggggaactcctggtgtagcggtgaaatgcgcagatatcaggaggaacaccggtggcgaaggcggttctctgggccttacctgacactgaggagcgaaagcgtggggagcgaacagg

SEQ ID NO: 333 - DNA, 254 bp, Unknown
  Description of Unknown: bacterium polynucleotide
  Acidimicrobiia; C111
cacgtaggggccaagcgttgtccggatttattgggcgtaaagagctcgtaggcggttcagcaagtcgggtgtgaaaactctgggctcaacccagagacgccacccgatactgctgtgactagagtccggtaggggagtggggaattcctggtgtagcggtgaaatgcacagatatcaggaggaacaccggtggcgaaggcgccactctgggccggcactgacgctgaggagcgaaagcgtgggtagcaaacagg

SEQ ID NO: 334 - DNA, 254 bp, Unknown
  Description of Unknown: bacterium polynucleotide
  Acidimicrobiia; EB1017
tacgtagggggcaagcgttgtccggatttattgggcgtaaagagctcgtaggcggtttggtaagtcgggtgtgaaatctccacgctcaacgtggaggggccactcgatactgccatgactcgagtccggtagaggagtgtggaattcccggtgtagcggtgaaatgcgcagatatcgggaggaacacccgtagcgaaggcggcactctgggccggaactgacgctgaggagcgaaagcgtggggagcaaacagg

SEQ ID NO: 335 - DNA, 254 bp, Unknown
  Description of Unknown: bacterium polynucleotide
  Acidimicrobiia; EB1017
tacgtagggggcaagcgttgtccggattcattgggcgtaaagagctcgtaggcggttcagtaagtcgggtgtgaaatctccgtgctcaacacggagcggccacctgatactgctgtgactcgagtccggtaggggagtgtggaattcccggtgtagcggtgaaatgcgcagatatcgggaggaacaccagtagcgaaggcggcactctgggccgtgactgacgctgaggagcgaaagcgtgggtagcaaacagg

SEQ ID NO: 336 - DNA, 254 bp, Unknown
  Description of Unknown: bacterium polynucleotide
  Acidimicrobiia; EB1017
tacgtagggggcaagcgttgtccggatttattgggcgtaaagagctcgtaggtggttcggtaagtcggatgtgaaatctccaggctcaacctggaggggtcattcgatactgccgtgactagaggtcggtaggggagtgtggaattcctggtggagcggtgaaatgcgcagatatcaggaggaacacccgtagcgaaggcggcactctgggccgatactgacactgaggagcgaaagcgtggggagcgaacagg

SEQ ID NO: 337 - DNA, 254 bp, Unknown
  Description of Unknown: bacterium polynucleotide
  Acidimicrobiia; Iamiaceae
cacgtagggggcaagcgttgtccggattcattgggcgtaaagagctcgtaggcggctcagcaagtcaggtgtgaaacctccgggctcaacccggagacgccacctgatactgctgtggctagagtccagtaggggagcgtggaattcccggtgtagcggtgaaatgcgcagatatcgggaggaacaccagtggcgaaggcggcgctctgggctggtactgacgctgaggagcgaaagcgtggggagcgaacagg

SEQ ID NO: 338 - DNA, 254 bp, Iamia sp.
  Acidimicrobiia; Iamiaceae; Iamia
cacgtagggggcaagcgttgtccggattcactgggcgtaaagagctcgtaggcggttcgataagtcgggtgtgaaacctccaggctcaacctggagacgccacccgatactgtcgtgactagagtccagtaggggagcgtggaattcctggtgtagcggtgaaatgcgcagatatcaggaggaacaccagcggcgaaggcggcgctctgggctggaactgacgctgaggagcgaaagcgtggggagcgaacagg

SEQ ID NO: 339 - DNA, 254 bp, Unknown
  Description of Unknown: bacterium polynucleotide
  Acidimicrobiia; Microthrixaceae
tacgtagggggcgagcgttgtccggaatcattgggcgtaaagagctcgtaggcggttcagtaagtcaggtgtgaaagctccgagctcaactcggagaggccacctgatactgctgtgactagaatccagtaggggagtgtggaactcctggtgtagcggtgaaatgcgcagatatcaggaagaccaccagcggcgaaggcggcactctgggctggaattgacgctgaggagcgaaagtgtgggtagcaaacagg

SEQ ID NO: 340 - DNA, 254 bp, Unknown
  Description of Unknown: bacterium polynucleotide
  Acidimicrobiia; Microthrixaceae
tacgaggggggcaaatgttgttcggaatcattgggcgtaaagagctcgtaggcggttcagtaagtcaggtgtgaaagctccgagctcaactcggagaggccacctgatactgctgtgactagaatccagtaggggagtgtggaactcctggtgtagcggtgaaatgcgcagatatcaggaagaacaccagcggcgaaggcggcactctgggctggtattgacgctgaggagcgaaagtgtgggtagcaaacagg

SEQ ID NO: 341 - DNA, 253 bp, Unknown
  Description of Unknown: bacterium polynucleotide
  Acidobacteria-5
tacggggggggcaagcgttgttcggaattactgggcgtaaagggcgcgtaggcggtttgctaagttggatgtgaaaactctgggcttaacccagagcctgcatccaaaactggcaaacttgagtactggaggggaaagcggaattcctggtgtagcggtgaaatgcgtagatatcaggaggaacaccggtggcgaaggcggctttctggacagtaactgacgctgaggcgcgaaagctaggggagcaaacagg

SEQ ID NO: 342 - DNA, 253 bp, Unknown
  Description of Unknown: bacterium polynucleotide
  Acidobacteria-5
tacagagactgcaagcgttattcggattcactgggcgtaaagggtgcgtaggcggctttctaagtcggatgtgaaaactctgggctcaacccagagcctgcatctgaaactggagagctagggttctggaggggaaagcggaattcctggtgtagcggtgaaatgcgtagatatcaggaggaacaccggtggcgaaggcggctttctggacagataccgacgctgaggcacgaaagctaggggagcaaacagg

SEQ ID NO: 343 - DNA, 253 bp, Unknown
  Description of Unknown: bacterium polynucleotide
  Acidobacteria-6
tacagagggggcaagcgttgttcggaattactgggcgtaaagggcgcgtaggcggcctgttaagtcgaacgtgaaatccccgggctcaacccgggaactgcgtccgatactggcaggcttgaattcgggagagggatgcggaattccaggtgtagcggtgaaatgcgtagatatctggaggaacaccggtggcgaaggcggcatcctggaccgagattgacgctgaggcgcgaaagccaggggagcaaacggc

SEQ ID NO: 344 - DNA, 253 bp, Unknown
  Description of Unknown: bacterium polynucleotide
  Acidobacteria-6
tacggggggggcaagcgttgttcggaattactgggcgtaaagggcgcgtaggcggcctgctaagtcggacgtgaaatccctcggctcaaccgaggaactgcgtctgatactggcgggctcgaatccgggagagggatgtggaattccaggagtagcggtgaaatgcgtagatatctggaggaacaccagtggcgaaggcggcatcctggaccggtattgacgctgatgcgcgaaagccaggggagcaaacggg

SEQ ID NO: 345 - DNA, 253 bp, Unknown
  Description of Unknown: bacterium polynucleotide
  Acidobacteria-6
tacagagggggcaagcgttgttcggaattactgggcgtaaagggcgcgtaggcggccttctaagtcgaacgtgaaatccccgggctcaacccgggaactgcgtccgagactggaaggctcgaatccgggagagggatgtggaattccaggtgtagcggtgaaatgcgtagatatctggaggaacatcggtggcgaaggcggcatcctggaccggtattgacgctgaggcgcgaaagccaggggagcaaacggg

SEQ ID NO: 346 - DNA, 253 bp, Unknown
  Description of Unknown: bacterium polynucleotide
  Acidobacteria-6
tacggggggggtaagcgttgttcggaattactgggcgtaaagggctcgtaggcggccaactaagtcatacgtgaaatccctcagcttaactggggaactgcgtgtgatactggatggcttggatttgggagagggatgcggaattccaggtgtagcggtgaaatgcgtagatatctggaggaacaccggtggcgaaggcggcatcctggaccaatattgacgctgaggagcgaaagccaggggagcaaacggg

SEQ ID NO: 347 - DNA, 254 bp, Unknown
  Description of Unknown: bacterium polynucleotide
  Acidobacteria-6
tacgggggggggcaagcgttgttcggaattactgggcgtaaagggctcgtaggtggccaactaagtcagacgtgaaatccctcggcttaaccggggaactgcgtctgatactggatggcttgagtttgggagagggatgcggaattccaggtgtagcggtgaaatgcgtagatatctggaggaacaccggtggcgaaggcggcatcctggaccaatactgacactgaggagcgaaagccaggggagcaaacggg

SEQ ID NO: 348 - DNA, 253 bp, Unknown
  Description of Unknown: bacterium polynucleotide
  Acidobacteria-6
tacggggggggcaagcgttgttcggaattactgggcgtaaagggctcgtaggtggccaactaagtcaaccgtgaaatccctcggcttaaccggggaactgcgtctgatactggatggcttgagttcgggagagggatgcggaattccaggtgtagcggtgaaatgcgtagatatctggaggaacaccggtggcgaaggcggcatcctggaccgagactgacactgaggagcgaaagccaggggagcaaacggg

SEQ ID NO: 349 - DNA, 253 bp, Unknown
  Description of Unknown: bacterium polynucleotide
  Acidobacteria-6
tacggggggggcaagcgttgttcggaattactgggcgtaaagggctcgtaggcggccaactaagtcagacgtgaaatccctcggcttaaccggggaactgcgtctgatactggatggctcgagtttgggagagggatgcggaattccaggtgtagcggtgaaatgcgtagatatctggaggaacaccggtggcgaaggcggcatcctggaccaacactggcgttgatgagcgaaagccaggggagcaaacggg

SEQ ID NO: 350 - DNA, 253 bp, Unknown
  Description of Unknown: bacterium polynucleotide
  Acidobacteria-6
tacggggggggcaagcgttgttcggaattactgggcgtaaagggctcgtaggcggccaactaagtcagacgtgaaatccctcggcttaaccggggaactgcgtctgatactggatggcttgagtgtgggagagggatgcggaattccaggtgtagcggtgaaatgcgtagatatctggaggaacaccggtggcgaaggcggcatcctggactactactgacgctgaggagcgaaagccaggggagcaaacggg

SEQ ID NO: 351 - DNA, 253 bp, Unknown
  Description of Unknown: bacterium polynucleotide
  Acidobacteria-6
tacagagggggcaagcgttgttcggaattactgggcgtaaagggcgcgtaggcggccgcctaagtcagacgtgaaatccctcggctcgaccggggaactgcgtctgatactgggtggcttgaatccgggagagggatgcggaattccaggtgtagcggtgaaatgcgtagatatctggaggaacaccggtggcgaaggcggcatcctggaccggcattgacgctgaggcgcgaaagccaggggagcaaacggg

SEQ ID NO: 352 - DNA, 253 bp, Unknown
  Description of Unknown: bacterium polynucleotide
  Acidobacteria-6
tacagagggggcaagcgttgttcggaattactgggcgtaaagggcgcgtcggcggcctgctaagtcgaacgtgaaatccctgggctcaacccaggaactgcgtccgatactggttgacttgaatccgggagagggatgtggaattccaggtgtagcggtgaaatgcgtagatatctggaggaacaccggtggcgaaggcggcatcctggaccggcattgacgctgaggtgcgaaagccgggggagcaaacggg

SEQ ID NO: 353 - DNA, 252 bp, Unknown
  Description of Unknown: bacterium polynucleotide
  Acidobacteria-6
tacgggggggcaagcgttgttcggaattactgggcgtaaagggctcgtaggcggccaactaagtcagacgtgaaatccctaggctcaacctaggaactgcgtctgatactggatggcttgaatccgggagagggatgcagaattccaggtgtagcggtgaaatgcgtagatatctggaggaataccggtggcgaaggcggcatcctggaccggcattgacgctgaggagcgaaagccaggggagcaaacggg

SEQ ID NO: 354 - DNA, 253 bp, Unknown
  Description of Unknown: bacterium polynucleotide
  Acidobacteria-6
tacggggggggcaagcgttgttcggaattactgggcgtaaagggctcgtaggcggccaactaagtcggatgtgaaatccccaggcttaacctgggaactgcatccgatactggatggcttgaatccgggagagggatgcagaattccaggtgtagcggtgaaatgcgtagatatctgggggaataccggtggcgaaggcggcatcctggaccggcattgacgctgatgagcgaaagctaggggagcaaacggg

SEQ ID NO: 355 - DNA, 253 bp, Unknown
  Description of Unknown: bacterium polynucleotide
  Acidobacteria-6
tacagagggggcaagcgttgttcggaattactgggcgtaaagggcgcgtaggcggcctgctaagtcgaacgtgaaatccctgggctcaacccaggaactgcgtccgatactggttggcttgaattcgggagagggatgtggaattccaggtgtagcggtgaaatgcgtagatatctggaggaacaccggtggcgaaggcggcatcctggaccgatattgacgctgatgcgcgaaagccaggggagcaaacggg

SEQ ID NO: 356 - DNA, 253 bp, Unknown
  Description of Unknown: bacterium polynucleotide
  Acidobacteria-6
tacagagggggcaagcgttgttcggaattactgggcgtaaagggcgcgtaggcggcctgctaagtcgaacgtgaaatccctgggctcaacccaggaactgcgtccgagactggttggcttgaatccgggggagggatgtggaattccaggtgtagcggtgaaatgcgtagatgtttggaggaacaccggtggcgaaggcggcatcctggaccggcattgacgctgaggcgcgaaagccaggggagcaaacggg

SEQ ID NO: 357 - DNA, 253 bp, Unknown
  Description of Unknown: bacterium polynucleotide
  Acidobacteria-6
tacggggggggtaagcgttgttcggaattactgggcgtaaagggctcgtgggcggccaactaagtcagacgtgaaatccccaggctcaacctgggaactgcgtctgatactggatggcttgaatccgggagagggatgcagaattccaggtgtagcggtgaaatgcgtagatatctggaggaataccggtggcgaaggcggcatcctggaccggcattgacgctgaggagcgaaagctaggggagcaaacggg

SEQ ID NO: 358 - DNA, 253 bp, Unknown
  Description of Unknown: bacterium polynucleotide
  Acidobacteria-6
tacgaagggggctagcgttgctcggaattactgggcgtaaagggctcgtaggtggccaactaagtcagacgtgaaatccctcggcttaaccggggaactgcgtctgatactggatggcttgagtttgggagagggacgcggaattccaggtgtagcggtgaaatgcgtagatatctggaggaacaccggtggcgaaggcggcgtcctggaccaacactgacactgaggagcgaaagccaggggagcaaacggg

SEQ ID NO: 359 - DNA, 253 bp, Unknown
  Description of Unknown: bacterium polynucleotide
  Acidobacteria-6
tacggggggggcaagcgttgttcggaattactgggcgtaaagggctcgtaggcggccaactaagtccgacgtgaaatccccaggcttaacctgggaatggcgtcggatactggatggcttgaattcgggagagggatgcagaattccaggtgtagcggtgaaatgcgtagatatctggaggaataccggtggcgaaggcggcatcctggaccgacattgacgctgatgagcgaaagctaggggagcaaacggg

SEQ ID NO: 360 - DNA, 253 bp, Unknown
  Description of Unknown: bacterium polynucleotide
  Acidobacteria-6
tacagggggggcaagcgttgttcggaattactgggcgtaaagggctcgtaggcggccaactaagtcacacgtgaaatccccaggctcaacctgggaactgcgtgtgatactggatggcttgaattcgggagagggatgcagaattccaggtgtagcggtgaaatgcgtagatatctggaggaataccggtggcgaaggcggcatcctggaccgacattgacgctgatgagcgaaagctaggggagcaaacggg

SEQ ID NO: 361 - DNA, 253 bp, Unknown
  Description of Unknown: bacterium polynucleotide
  Acidobacteria-6
tacgaggggtgcaagcgttgctcggaattactgggcgtaaagggctcgtaggtggccaactaagtcagacgtgaaatccctcagcttaactggggaactgcgtctgatactggatggcttgagtttgggagagggatgcggaattccaggtgtagcggtgaaatgcgtagatatctggaggaacaccggtggcgaaggcggcatcctggaccaacactgacaccgatgagcgaaagccaggggagcaaacggg

SEQ ID NO: 362 - DNA, 253 bp, Unknown
  Description of Unknown: bacterium polynucleotide
  Acidobacteria-6
tacagagggggcaagcgttgttcggaattactgggcgtaaagggcgcgtaggcggcctgttaagtcggacgtgaaatccctcggctcaaccggggaactgcgtccgatactggcgggcttgagttcgggagagggatgcggaattccaggagtagcggtgaaatgcgtagatatctggaggaacaccggtggcgaaggcggcatcctggaccgacactgacgctgaggagcgaaagccaggggagcaaacggg

SEQ ID NO: 363 - DNA, 253 bp, Unknown
  Description of Unknown: bacterium polynucleotide
  Acidobacteria-6
tacagggggggcaagcgttgttcggaattactgggcgtaaagggctcgtaggtggccaactaagtcagacgtgaaatccctcagcttaactggggaactgcgtctgatactggatggcttgagtttgggggagggatgcggaattccaggtgtagcggcgaaatgcgtagatatctggaggaacaccggtggcgaaggcggcatcctggaccaacactgacactgaggagcgaaagccaggggagcaaacggg

SEQ ID NO: 364 - DNA, 253 bp, Unknown
  Description of Unknown: bacterium polynucleotide
  Acidobacteria-6
tacggggggagcaagcgttgttcggaattactgggcgtaaagggctcgtaggcggccaactaagtcagacgtgaaatccctcggctcaaccggggaactgcgtctgatactggatggcttgaatccggaagagggatgcggaattccaggtgtagcggtgaaatgcgtagatatctggaggaacaccggtggcgaaggcggcatcctgggtcggtattgacgctggggagcgaaagccaggggagcaaacggg

SEQ ID NO: 365 - DNA, 253 bp, Unknown
  Description of Unknown: bacterium polynucleotide
  Acidobacteria-6; mb2424
tacagaggtggcaagcgttgttcggaattactgggcgtaaagggcgcgtaggcggccatctaagtcagacgtgaaatcccccggcttaacctgggaactgcgtctgatactgggaggcttgagtatgggagagggatgtagaattccaggtgtagcggtgaaatgcgtagatatctggaggaataccggtggcgaaggcggcatcctggaccattactgacgctgaggcgcgaaagctaggggagcaaacggg

SEQ ID NO: 366 - DNA, 253 bp, Unknown
  Description of Unknown: bacterium polynucleotide
  Acidobacteria-6; mb2424
tacagaggtggcaagcgttgttcggaattactgggcgtaaagggcgcgtaggcggccctctaagtcagacgtgaaatcccccggcttaacctgggaactgcgtctgatactggagggcttgagtatgggagagggatgtagaattccaggtgtagcggtgaaatgcgtagatatcgggaggaacaccagtggcgaaggcgactatctgggctgaaactgacgctgaggcgcgaaggctaggggagcgaacagg

SEQ ID NO: 367 - DNA, 253 bp, Unknown
  Description of Unknown: bacterium polynucleotide
  Acidobacteria-6; mb2424
tacagaggtggcaagcgttgttcggaattactgggcgtaaagggcgcgtaggcggtcgcctaagtcggacgtgaaatccccaagcttaacttgggaactgcgtccgatactgggtgacttgagttcgggagaggaatgtggaattccaggtgtagcggtgaaatgcgtagatatctggaggaacaccggtggcgaaggcggcattctggaccgaaactgacgctgaggcgcgaaagccaggggagcaaacggg

SEQ ID NO: 368 - DNA, 253 bp, Unknown
  Description of Unknown: bacterium polynucleotide
  Acidobacteria-6; mb2424
tacagaggtggcaagcgttgttcggaattactgggcgtaaagggcgagtaggtggccatttaagtcagacgtgaaatcccccggcttaacctgggaactgcgtctgatactggacggcttgagtatgggagaggaatgtagaattccagatgtagcggtgaaatgcgtagatatctggaggaataccggtggcgaaggcggcattctggaccattactgacactgaatcgcgaaagctaggggagcaaacggg

SEQ ID NO: 369 - DNA, 253 bp, Unknown
  Description of Unknown: bacterium polynucleotide
  Acidobacteria-6; RB40
tacgaagggtgcaaacgttgctcggaatcattgggcgtaaagcgcacgtaggcggcgttctaagtcggatgtgaaatccctcagcttaactggggaactgcttctgatactggttggcttgagtgcaggagaggaatgcggaattccaggtgtagcggtgaaatgcgtagatatctggaggaacaccggtggcgaaggcggcattctggactgtaactgacactgaggaacgaaagccaggggagcaaacggg

SEQ ID NO: 370 - DNA, 253 bp, Unknown
  Description of Unknown: bacterium polynucleotide
  Acidobacteria-6; RB40
tacggggggggcaagcgttgttcggaattactgggcgtaaagggttcgtaggtggccacttaagtcagacgtgaaatccctcagcttaactgaggaactgcgtctgatactgggtggcttgagtgcaggagagggatgcggaattccaggtgtagcggtgagatgcgtagatatctggaggaacaccggtggcgaaggcggcatcctggactgtaactgacactgaggaacgaaagccaggggagcaaacggg

SEQ ID NO: 371 - DNA, 253 bp, Unknown
  Description of Unknown: bacterium polynucleotide
  Acidobacteria-6; RB40
tacggggggggcaagcgttgttcggaattactgggcgtaaagggttcgtaggtggctcgctaagtcagacgtgaaatccctcagcttaactggggaactgcgtctgagactggcgagctcgagtgcaggagaggaacgcggaattccaggtgtagcggtgaaatgcgtagatatctggaggaacaccggtggcgaaggcggcgttctggactgcaactgacactgaggaacgaaagccagggtagcaaacggg

SEQ ID NO: 372 - DNA, 253 bp, Unknown
  Description of Unknown: bacterium polynucleotide
  Acidobacteria-6; RB40
tacagggggggcaagcgttgttcggaattactgggcgtaaagggttcgtaggtggccgcttaagtcagacgtgaaatccctcagcttaactggggaactgcgtctgatactgggaggcttgagtgcaggagaggaacgcggaattccaggtgtagcggtgaaatgcgtagatatctggaggaacaccggtggcgaaggcggcgttctggactgtaactgacactgaggaacgaaagccaggggagcaaacggg

SEQ ID NO: 373 - DNA, 253 bp, Unknown
  Description of Unknown: bacterium polynucleotide
  Acidobacteria-6; RB40
tacagagggtgcgagcgttaatcggatttactgggcgtaaagggttcgtaggtggctcgctaagccacacgtgaaatccctcagcttaactggggaactgcgtgtgggactggggagcttgaggacaggagaggaatgcggaattccaggtgtagcggtgaaatgcgtagatatctggaggaacaccggtggcgaaggcggcattctggactgtatctgacactgatgaacgaaagccaggggagcaaacggg

SEQ ID NO: 374 - DNA, 253 bp, Unknown
  Description of Unknown: bacterium polynucleotide
  Acidobacteria-6; RB40
tacagggggggcaagcgttgttcggaattactgggcgtaaagggtttgtaggtggcttgctcagtcagacgtgaaatccctcagcttaactggggaactgcgtctgatactagcgagcttgagtgcaggagaggaacgcggaattccaggtgtagcggtgaaatgcgtagatatctggaggaacaccggtggcgaaggcggcgttctggactgcaactgacactgaaaaacgaaagccaggggagcaaacggg

SEQ ID NO: 375 - DNA, 253 bp, Unknown
  Description of Unknown: bacterium polynucleotide
  Acidobacteriia; Acidobacteriaceae
tacgaggggggcaagcgttgttcggaattattgggcgtaaagggtgcgtaggcggtctgacaagtctgatgtgaaatctatgggctcaacccatagcctgcatcggaaactgtcgggcttgagtatgggagaggtgagtggaatttccggtgtagcggtgaaatgcgtagatatcggaaggaacacctgtggcgaaagcggctcactggaccattactgacgctgaggcacgaaagctaggggagcaaacagg

SEQ ID NO: 376 - DNA, 253 bp, Unknown
  Description of Unknown: bacterium polynucleotide
  Acidobacteriia; Acidobacteriaceae
tacggagggtgcaagcgttactcggaattattgggcgtaaagggtgcgtaggcggtttggtaagtctgatgtgaaatctatgggctcaactcatagtctgcatcggaaactgccgggcttgagtatgggagaggtgagtggaattcctggtgtagcggtgaaatgcgtagatatcaggaggaacacctgtggcgaaagcggctcactggaccataactgacgctgatgcacgaaagctaggggagcaaacagg

SEQ ID NO: 377 - DNA, 253 bp, Unknown
  Description of Unknown: bacterium polynucleotide
  Acidobacteriia; Acidobacteriaceae
tacgaggggggcaagcgttgttcggaattattgggcgtaaagggtgcgtaggcggttcggtaagtcttatgtgaaatcttcgggctcaactcgaagtctgcatgagaaactgccgggcttgagtgtgggagaggtgagtggaatttccggtgtagcggtgaaatgcgtagatatcggaaggaacacctgtggcgaaagcggctcactggaccataactgacgctgatgcacgaaagctaggggagcaaacagg

SEQ ID NO: 378 - DNA, 253 bp, Unknown
  Description of Unknown: bacterium polynucleotide
  Acidobacteriia; Acidobacteriaceae
tacggggggggcaagcgttgttcggaattattgggcgtaaagggtgcgtaggcggtttcgtaagtctgatgtgaaatctctgggctcaacccagaggctgcatcggagactgcgaggctggagagtgggagaggtgagtggaatttccggtgtagcggtgaaatgcgtagatatcggaaggaacacctgtggcgaaagcggctcactggaccatttctgacgctgatgcacgaaagctaggggagcaaacagg

SEQ ID NO: 379 - DNA, 253 bp, Unknown
  Description of Unknown: bacterium polynucleotide
  Acidobacteriia; Acidobacteriaceae
tacgaggggggcgagcgttgttcggaattattgggcgtaaagggtgcgtaggcggtttcgtaagtcctgtgtgaaatcttcgggctcaactcgaagtctgcacgggaaactgcggggcttgagtgtgggagaggtgagtggaattcccggtgtagcggtgaaatgcgtagatatcgggaggaacacctgtggcgaaagcggctcactggaccataactgacgctgatgcacgaaagctgggggagcaaacagg

SEQ ID NO: 380 - DNA, 253 bp, Unknown
  Description of Unknown: bacterium polynucleotide
  Acidobacteriia; Acidobacteriaceae
tacgaggggggcgagcgttgttcggaattattgggcgtaaagggtgcgtaggcggtttggtaagtcttatgtgaaatctacaggctcaacttgtagtctgcgtgagaagctgccgggcttgagtatgggagaggtgagtggaattcctggtgtagcggtgaaatgcgtagatatcaggaggaacacctgtggcgaaagcggctcactggaccataactgacgctgatgcacgaaagcgtggggagcaaacagg

SEQ ID NO: 381 - DNA, 253 bp, Unknown
  Description of Unknown: bacterium polynucleotide
  Acidobacteriia; Acidobacteriaceae
tacgaggggggcgagcgttgttcggaattattgggcgtaaagggtgcgtaggcggtttggtaagtcttctgtgaaatctatgggcttaactcatagactgcatgagaaactgccgggcttgagtgtgggagaggtgagtggaatttccggtgtagcggtgaaatgcgtagatatcggaaggaacacctgtggcgaaagcggctcactggaccacaactgacgctgatgcacgaaagctaggggagcaaacagg

SEQ ID NO: 382 - DNA, 253 bp, Unknown
  Description of Unknown: bacterium polynucleotide
  Acidobacteriia; Acidobacteriaceae
tacgaggggggcaagcgttgttcggaattattgggcgtaaagggtgcgtaggtggttcggcaagtcttgtgtgaaatcttcaggctcaacttgaagtctgcacaagaaactgccgggcttgagtatgggagaggtgagtggaatttccggtgtagcggtgaaatgcgtagatatcggaaggaacacctgtggcgaaagcggctcactggaccattactgacactgaggcacgaaagctaggggagcaaacagg

SEQ ID NO: 383 - DNA, 253 bp, Unknown
  Description of Unknown: bacterium polynucleotide
  Acidobacteriia; Acidobacteriaceae
tacgaggggggcaagcgttgttcggaattattgggcgtaaagggtgcgtaggcggtttgacaagtcttatgtgaaatctatgggctcaacccatagtctgcatgagaaactgtcgggcttgagagtgggagaggtgagtggaatttccggtgtagcggtgaaatgcgtagatatcggaaggaacacctgtggcgaaagcggctcactggaccatttctgacgctgatgcacgaaagctaggggagcaaacagg

SEQ ID NO: 384 - DNA, 253 bp, Unknown
  Description of Unknown: bacterium polynucleotide
  Acidobacteriia; Acidobacteriaceae
tacgaggggggcaagcgttgttcggaattattgggcgtaaagggcgcgtaggcggtcggataagtcttgtgtgaaatcttcgggctcaactcgaagtctgcacgagaaactgtctggcttgagtgtgggagaggtgagtggaattcccggtgtagcggtgaaatgcgtagatatcgggaggaacacctgtggcgaaagcggctcactggaccacaactgacgctgaggcgcgaaagctaggggagcaaacagg

SEQ ID NO: 385 - DNA, 253 bp, Unknown
  Description of Unknown: bacterium polynucleotide
  Acidobacteriia; Acidobacteriaceae
tacgaggggggcaagcgttgttcggatttattgggcgtaaagggtgcgtaggcggtttgataagtctgatgtgaaatctatgggctcaacccatagtctgcattagaaactgtcgggcttgagtatgggagaggtgagtggaatttccggtgtagcggtgaaatgcgtagatatcggaaggaacacctgtggcgaaagcggctcactggaccataactgacgctgatgcacgaaagctaggggagcaaacagg

SEQ ID NO: 386 - DNA, 253 bp, Unknown
  Description of Unknown: bacterium polynucleotide
  Acidobacteriia; Acidobacteriaceae
tacgaggggggcaagcgttgttcggaattattgggcgtagagggtgcgtaggcggtttgataagtcatctgtgaaatctctgggctcaacccagagtctgcaggcgaaactgtcgggcttgagtatgggagaggtgagtggaatttccggtgtagcggtgaaatgcgtagatatcggaaggaacacctgtggcgaaagcggctcactggaccattactgacgctgatgcacgaaagctaggggagcaaacagg

SEQ ID NO: 387 - DNA, 253 bp, Unknown
  Description of Unknown: bacterium polynucleotide
  Acidobacteriia; Acidobacteriaceae
tacgaggggggcgagcgttgttcggaattattgggcgtaaagggtgcgtaggcggtttggtaagtcttgtgtgaaatctccaggctcaacttggagtctgcacgagaaactgccgggcttgagtgtgggagaggtgagtggaattcctggtgtagcggtgaaatgcgtagatatcaggaggaacacctgtggcgaaagcggctcactggaccacaactgacgctgatgcacgaaagctaggggagcaaacagg

SEQ ID NO: 388 - DNA, 253 bp, Unknown
  Description of Unknown: bacterium polynucleotide
  Acidobacteriia; Acidobacteriaceae
tacgaggggggcaagcgttgttcggatttattgggcgtaaagggtgcgtaggcggtttggcaagtcttatgtgaagtcttcgggctcaacccgaagcctgcataagaaactgccgggcttgagtatgggagaggtgagtggaatttccggtgtagcggtgaaatgcgtagatatcggaaggaacacctgtggcgaaagcggctcactggaccataactgacgctggtgcacgaaagctaggggagcaaacagg

SEQ ID NO: 389 - DNA, 253 bp, Unknown
  Description of Unknown: bacterium polynucleotide
  Acidobacteriia; Acidobacteriaceae
tacgaggggggcgagcgttgttcggaattattgggcgtaaagggtgcgtaggcggtttggtaagtcttttgtgaaatctctgggctcaactcagagtctgcaagggaaactgccgggctggagtgtgggagaggtgagtggaatttccggtgtagcggtgaaatgcgtagatatcggaaggaacacctgtggcgaaagcggctcactggaccacaactgacgctgatgcacgaaagctaggggagcaaacagg

SEQ ID NO: 390 - DNA, 252 bp, Granulicella paludicola
  Acidobacteriia; Acidobacteriaceae; Granulicella paludicola
tacgaggggggcaagcgttgttcggaattattgggcgtaagggtgcgtaggcggtttgataagtttgatgtgaaatctctgggctcaacccagagtctgcatcgaaaactgtcgggcttgagtatgggagaggtgagtggaatttccggtgtagcggtgaaatgcgtagatatcggaaggaacacctgtggcgaaagcggctcactggaccattactgacgctgatgcacgaaagctaggggagcaaacagg

SEQ ID NO: 391 - DNA, 253 bp, Unknown
  Description of Unknown: bacterium polynucleotide
  Acidobacteriia; Koribacteraceae
tacagagggtgcgagcgttgttcggaattattgggcgtaaagggcgcgtaggcggtgccacaagtcacttgtgaaatccccgggcttaacccggggtctgcaggcgaaactgtggtgctggagtgtgggagaggtgcgtggaattcccggtgtagcggtgaaatgcgtagatatcgggaggaacacctgtggcgaaagcggcgcactggaccataactgacgctgaggcgcgaaagctaggggagcaaacagg

SEQ ID NO: 392 - DNA, 253 bp, Unknown
  Description of Unknown: bacterium polynucleotide
  Acidobacteriia; Koribacteraceae
gacggggggggcaagtgttcttcggaattattgggcgtaaagggcgcgtaggcggcgcggtatgtcacctgtgaaatctcctggctcaactgggagcttgcaggcgaaactgccgtgctggagtgtgggagaggtgcgtggaattcccggtgtagcggtggaatgcgtagatatcgggaggaacacctgtggcgaaagcggcgcactggaccacaactgacgctgaggcgcgaaagctaggggagcaaacagg

SEQ ID NO: 393 - DNA, 253 bp, Unknown
  Description of Unknown: bacterium polynucleotide
  Acidobacteriia; Koribacteraceae
tacagagggtgcgagcgttgttcggaattattgggcgtaaagggcgcgtaggcggtgcggtaagtcacctgtgaaatctccgggcttaactcggagcgtgcaggcgaaactgccgtgctcgagtgtgggagaggtgcgtggaattcccggtgtagcggtgaaatgcgtagatatcgggaggaacacctgtggcgaaagcggcgcactggaccataactgacgctgatgcgcgaaagctaggggagcaaacagg

SEQ ID NO: 394 - DNA, 253 bp, Unknown
  Description of Unknown: bacterium polynucleotide
  Acidobacteriia; Koribacteraceae
tacagagggtgcaagcgctgttcggaattattgggcgtaaagggcgcgtaggcggtgccacaagtcacttgtgaaatctccgggcttaactcggagcctgcaggcgaaactgtggtgctggagtgtgggagaggtgcgtggaattcccggtgtagcggtgaaatgcgtaggtatcgggaggaacacctgtggcgaaagcggcgcactggaccataactgacgctgatgcgcgaaagctaggggagcaaacagg

SEQ ID NO: 395 - DNA, 253 bp, Unknown
  Description of Unknown: bacterium polynucleotide
  Acidobacteriia; Koribacteraceae
tacagagggtgcgagcgttgttcggaattattgggcgtaaagggcgcgtaggcggcgcggtatgtcacctgtgaaatctcctggctcaactgggagcttgcaggcgaaactgccgtgctggagtgtgggagaggtgcgtggaattcccggtgtagcggtgaaatgcgtagatatcgggaggaacacctgtggcgaaagcggcgcactggaccacaactgacgctgaggcgcgaaagctaggggagcaaacagg

SEQ ID NO: 396 - DNA, 253 bp, Unknown
  Description of Unknown: bacterium polynucleotide
  Acidobacteriia; Koribacteraceae
tacgaggggggcaagcgttgttcggaattattgggcgtaaagggtgcgtaggcggtgcggtaagtcacctgtgaaaactcccggctcaactgggagcctgcaggcgaaactgccgtgctggagtgtgggagaggtgagtggacttcccggtgtagcggtgaaatgcctagatatcgggaggaacacctgtggcgaaagtggctcactggaccataactgacgctgatgcacgaaagctaggggagcaaacagg

SEQ ID NO: 397 - DNA, 253 bp, Unknown
  Description of Unknown: bacterium polynucleotide
  Acidobacteriia; Koribacteraceae
tacagagggtgcgagcgttgttcggaattattgggcgtaaagggcgcgtaggcggttgggtaagtcacctgtgaaatctcctggctcaactgggagcttgcaggcgaaactgcttgactggagtatgggagaggtgcgtggaattcccggtgtagcggtgaaatgcgtaggtatcgggaggaacacctgtggcgaaagcggcgcactggaccataactgacgctgaggcgcgaaagctaggggagcaaacagg

SEQ ID NO: 398 - DNA, 253 bp, Unknown
  Description of Unknown: bacterium polynucleotide
  Acidobacteriia; Koribacteraceae
tacagagggtgcgagcgttgttcggaattattgggcgtaaagggcgcgtaggcggcgccacaagtcacctgtgaaaactctgggctcaacccagagcctgcaggcgaaactgtggtgctggagtatgggagaggtgcgtggaattcccggtgtagcggtgaaatgcgtagatatcgggaggaacacctgtggcgaaagcggcgcactggaccataactgacgctgaggcgcgaaagctaggggagcaaacagg

SEQ ID NO: 399 - DNA, 253 bp, Unknown
  Description of Unknown: bacterium polynucleotide
  Acidobacteriia; Koribacteraceae
tacgaggggggcgagcgttgttcggaattattgggcgtaaagggcgcgtaggcggtgcggtaagtcacctgtgaaacccccgggctcaactcggggcctgcaggcgaaactgccgtgctggagtgcggaagaggtgagtggaattcccggtgtagcggtgaaatgcgtagatatcgggaggaacacctgtggcgaaagcggctcactggaccgcaactgacgctgaggcgcgaaagctaggggagcaaacagg

SEQ ID NO: 400 - DNA, 253 bp, Unknown
  Description of Unknown: bacterium polynucleotide
  Acidobacteriia; Koribacteraceae
tacgaggggggcaagcgttgttcggaattattgggcgtaaagggcgcgtaggcggtgcggtaagtcacctgtgaaacctctaggctcaacctagagcctgcaggcgaaactgccgtgcttgagggtgggagaggtgcgtggaattcccggtgtagcggtgaaatgcgtagatatcgggaggaacacctgtggcgaaagcggcgcactggaccacttctgacgctgaggcgcgaaagctaggggagcaaacagg

SEQ ID NO: 401 - DNA, 253 bp, Unknown
  Description of Unknown: bacterium polynucleotide
  Acidobacteriia; Koribacteraceae
tacgaggggggcaagcgttgttcggaattattgggcgtaaagggtgcgtaggcggcgcggtatgtttcttgtgaaatctccaggctcaacttggagtctgcaagggaaactgccgtgcttgagtactggagaggtgagtggaattcccggtgtagcggtgaaatgcgtagatatcgggaggaacacctgtggcgaaagcggctcactggacagtaactgacgctgatgcacgaaagctaggggagcaaacagg

SEQ ID NO: 402 - DNA, 253 bp, Unknown
  Description of Unknown: bacterium polynucleotide
  Acidobacteriia; Koribacteraceae
tacggggggggcaagcgttgttcggaattattgggcgtaaagggcgcgtaggcggtgccacaagtcacttgtgaaatccccaggcttaacctggggcctgcaggcgaaactgtggtgctggagtgtgggagaggtgcgtggagttcccggtgtagcggtgaaatgcgtagatatcgggaggaacacctgtggcgaaagcggcgcactggaccataactgacgctgaggcgcgaaagctaggggagcaaacagg

SEQ ID NO: 403 - DNA, 253 bp, Unknown
  Description of Unknown: bacterium polynucleotide
  Acidobacteriia; Koribacteraceae
tacgaggggggcaagcgttgttcggaattattgggcgtaaagggcgcgtaggcggtgcggtaagtcacctgtgaaatctccgggctcaactcggagcctgcaggcgatactgccgtgcttgaggatgggagaggtgcgtggaattcccggtgtagcggtgaaatgcgtagatatcgggaggaacacctgtggcgaaagcggcgcactggaccatttctgacgctgaggcgcgaaagctaggggagcaaacagg

SEQ ID NO: 404 - DNA, 253 bp, Candidatus koribacter
  Acidobacteriia; Koribacteraceae; Candidatus Koribacter
tacagagggtgcaagcgttgttcggaattattgggcgtaaagggtgcgtaggcggtgctgtaagtctgtagtgaaatctctgggctcaactcagagactgctatagaaactgcagtgctagagtgtgggagaggtgagtggaattcccggtgtagcggtgaaatgcgtagatatcgggaggaacacctgtggcgaaagcgtctcactggaccacaactgacgctgatgcacgaaagctaggggagcaaacagg

SEQ ID NO: 405 - DNA, 253 bp, Candidatus koribacter
  Acidobacteriia; Koribacteraceae; Candidatus Koribacter
tacagagggtgcaagcgttgttcggaattattgggcgtaaagggcgcgtaggcggtgctgtaagtctgtggtgaaatctctgggctcaactcagagtctgccatagaaactgcagtgctagagtgtgggagaggtgagtggaattcctggtgtagcggtgaaatgcgtagatatcgggaggaacacctgtggcgaaagcggctcactggaccacaactgacgctgaggcgcgaaagctaggggagcaaacagg

SEQ ID NO: 406 - DNA, 253 bp, Candidatus koribacter
  Acidobacteriia; Koribacteraceae; Candidatus Koribacter
tacagagggtgcaagcgttgttcggaattattgggcgtaaagggcgcgtaggcggtgcggtaagtctgtagtgaaatctctgggctcaactcagagtctgctgcagaaactgccgtgcttgagtgtgggagaggtgagtggaattcccggtgtagcggtgaaatgcgtagatatcgggaggaacacctgtggcgaaagcggctcactggaccacaactgacgctgaggcgcgaaagctaggggagcaaacagg

SEQ ID NO: 407 - DNA, 253 bp, Candidatus koribacter
  Acidobacteriia; Koribacteraceae; Candidatus Koribacter
taccgagggtgcaagcgttgttcggaattattgggcgtaaagggtgcgtaggcggtgcggtaagtctgttgtgaaatctccgggatcaactcggagtctgcaacggaaactgccgtgctggagtgtgggagaggtgagtggaattcccggtgtagcggtgaaatgcgtagatatcgggaggaacacctgtggcgaaagcggctcactggaccacaactgacgctgatgcacgaaagctaggggagcaaacagg

SEQ ID NO: 408 - DNA, 253 bp, Candidatus koribacter
  Acidobacteriia; Koribacteraceae; Candidatus Koribacter
tacagagggtgcaagcgttgttcggaattattgggcgtaaagggtgcgtaggcggtgcggtaagtctgtggtgaaatctccgggctcaactcggagtctgccgcggaaactgccgtgcttgagtatgggagaggtgagtggaattcccggtgtagcggtgaaatgcgtagatatcgggaggaacacctgtggcgaaagcggctcactggaccattactgacgctgatgcacgaaagctaggggagcaaacagg

SEQ ID NO: 409 - DNA, 253 bp, Candidatus koribacter
  Acidobacteriia; Koribacteraceae; Candidatus Koribacter
tacgaggggggcaagcgttgttcggaattattgggcgtagagggcgcgtaggcggtgtcgcaagtccgtggtgaaatctctaggctcaacttagagactgccgcggaaactgcggtgcttgagtgtgggagaggtgcgcggaattcccggtgtagcggtgaaatgcgtagatatcgggaggaacacctgtggcgaaagcggcgcactggaccacaactgacgctgaggcgcgaaagctaggggagcaaacagg

SEQ ID NO: 410 - DNA, 253 bp, Candidatus koribacter
  Acidobacteriia; Koribacteraceae; Candidatus Koribacter
tacagagggtgcaagcgttgttcggaattattgggcgtaaagggcgcgtaggcggtgcggtaagtcttttgtgaaatctccgggctcaactcggagtctgcaagagaaactgccgtgctggagtatgggagaggtgagtggaattcccggtgtagcggtgaaatgcgtagatatcgggaggaacacctgtggcgaaagcggctcactggaccattactgacgctgaggcgcgaaagctaggggagcaaacagg

SEQ ID NO: 411 - DNA, 253 bp, Unknown
  Description of Unknown: bacterium polynucleotide
  Actinobacteria
tacgtagggcgcaagcgttgtccggaattattgggcgtaaagagctcgtaggcggtttgtcgcgtctgctgtggaatcctcaggctcaacctggggcgtgcagtgggtacgggcagactagagtgcggtaggggagactggaattcctggtgtagcggtggaatgcgcagatatcaggaggaacaccggtggcgaaggcgggtctctgggccgttactgacgctgaggagcgaaagcatggggagcgaacagg

SEQ ID NO: 412 - DNA, 253 bp, Unknown
  Description of Unknown: bacterium polynucleotide
  Actinobacteria
tacgtagggcgcaagcgttgtccggaattattgggcgtaaagagctcgtaggcggctagtcgcgtctgctgtgaaatcccggggctcaaccccgggcgtgcagtggatacgggctggctagaggcaggcaggggagaacggaattcccggtgtagcggtgaaatgcgcagatatcgggaggaacaccggtggcgaaggcggttctctgggcctgtactgacgctgaggagcgaaagcgtggggagcgaacagg

SEQ ID NO: 413 - DNA, 253 bp, Unknown
  Description of Unknown: bacterium polynucleotide
  Actinobacteria
tacgtagggtgcaagcgttgtccggaattattgggcgtaaagagttcgtaggcggtttgtcgcgtccgttgtgaaagcttggggctcaaccccaagtctgcagtggatacgggcagactagagtcaggtaggggagaacggaattcctggtgtagcggtgaaatgcgcagatatcaggaggaacaccggtggcgaaggcggttctctgggcctgtactgacgctgaggaacgaaagcgtggggagcgaacagg

SEQ ID NO: 414 - DNA, 253 bp, Unknown
  Description of Unknown: bacterium polynucleotide
  Actinobacteria
tacgtagggtgcgagcgttgtccggatttattgggcgtaaagagctcgtaggcggttcgtcgcgtctgtcgtgaaagcccgcggctcaactgcgggtctgcggtggatacgggcggactggagtccgacaggggagactggaattcctggtgtagcggtggaatgagcagatatcaggaggaacaccggtggcgaaggcgggtctctgggtcggtactgacgctgaggagcgaaagcgtggggagcgaacagg

SEQ ID NO: 415 - DNA, 253 bp, Unknown
  Description of Unknown: bacterium polynucleotide
  Actinobacteria
tacgtagggaccgagcgttgtccggattcattgggcgtaaagagctcgtaggcggccactcaagtcgaatgtgaaacctcgaggcttaacctcgagcctgcattcgatactgggcggctagagtctggtagggggatctggaattcctggtgtagcggtggaatgcgcagatatcaggaggaacaccggtggcgaaggcgggatcctgggccagtactgacgctgaggagcgaaagcgtggggagcaaacagg

SEQ ID NO: 416 - DNA, 253 bp, Unknown
  Description of Unknown: bacterium polynucleotide
  Actinobacteria
tacgtagggcgcaagcgttgtccggaattattgggcgtaaagagcttgtaggcggtttgtcgcgtctggtgtgaaaacccatcgcttaacggtgggcttgcatcgggtacgggcaggctagagtgcagtaggggagactggaattcctggtgtagcggtggaatgcgcagatatcaggaggaacaccggtggcgaaggcgggtctctgggctgttactgacgctgagaagcgaaagcatggggagcgaacagg

SEQ ID NO: 417 - DNA, 253 bp, Unknown
  Description of Unknown: bacterium polynucleotide
  Actinobacteria
tacgtagggcgcaagcgttgtccggaattattgggcgtaaagagctcgtaggcggcctgttgcgtccgctgtgaaatcccggggcttaaccccgggcgtgcagtggatacgggctggctagaggcaggcaggggagaacggaattcccggtgtagcggtgaaatgcgcagatatcgggaggaacaccggtggcgaaggcggttctccgggcctgttctgacgctgaggagcgaaagcgtggggagcaaacagg

SEQ ID NO: 418 - DNA, 253 bp, Unknown
  Description of Unknown: bacterium polynucleotide
  Actinobacteria
tacgtagggtgcgagcgttgtccggaattattgggcgtaaagagcttgtaggtggctcgttgcgtcgggagtgaaaacccgtggcttaaccgcgggcgtgcagtggatacgggcaggctggaggcaggcaggggagaacggaattcccggtgtagcggtgaaatgcgcagatatcgggaggaacaccggtggcgaaggcggttctctgggcctgtactgacgctgaggagcgaaagcgtggggagcgaacagg

SEQ ID NO: 419 - DNA, 253 bp, Unknown
  Description of Unknown: bacterium polynucleotide
  Actinobacteria
tacagagggtgcgagcgttaatcggaattactgggcgtaaagcgcacgtaggtggcgacgtaagtcgggtgtgaaagccccgggctcaacctgggaattgcattcgagactgtgttgctggagtacggaagaggagggcggaattcccggtgtagcggtggaatgcgcagatatcaggaggaacaccgatggcgaaggcagatctctgggccgtaactgacgctgaggagcgaaagcatggggagcgaacagg

SEQ ID NO: 420 - DNA, 253 bp, Unknown
  Description of Unknown: bacterium polynucleotide
  Actinobacteria
cacgtagggcgcaagcgttgtccggaattattgggcgtaaagagctcgtaggcggtctgttgcgtccgctgtgaaaactcggggcttaaccccgagcctgcagtggatacgggcagactagaggtaggtaggggagaatggaattcccggtgtagcggtgaaatgcgcagatatcgggaggaacaccggtggcgaaggcggttctctgggccttacctgacgctgaggagcgaaagcgtggggagcgaacagg

SEQ ID NO: 421 - DNA, 253 bp, Unknown
  Description of Unknown: bacterium polynucleotide
  Actinobacteria
cacgtagggcgcgagcgttgtccggaattattgggcgtaaagagctcgtaggcggcctgttgcgtccgctgtgaaagcccggggcttaaccccgggtctgcagtggatacgggcaggctagaggtaggtaggggagaatggaattcccggtgtagcggtgaaatgcgcagatatcaggaggaacaccggtggcgaaggcggttctctgggccttacctgacgctgaggagcgaaagcgtggggagcgaacagg

SEQ ID NO: 422 - DNA, 253 bp, Unknown
  Description of Unknown: bacterium polynucleotide
  Actinobacteria
tacgtagggtgcgagcgttgtccggaattattgggcgtaaagagctcgtaggcggttcgtcgcgtcgaatgtgaaatcccggggctcaactccgggtctgcattcgatacgggcggactagagttcggtaggggagactggaattcctggtgtagcggtgaaatgcgcagatatcaggaggaacaccggtggtgaaggcgggtctctgggccgatactgacgctgaggagcgaaagcgtggggagcaaacagg

SEQ ID NO: 423 - DNA, 253 bp, Unknown
  Description of Unknown: bacterium polynucleotide
  Actinobacteria
tacggagggtgcgagcgttgtccggaattattgggcgtaaagagctcgtaggcggctcgtcgcgtctgctgtgaaagcccggggcttaaccccgggtctgcagtgggtacgggcgggctagagtgcggtaggggagactggaattcctggtgtagcggtgaaatgcgcagatatcaggaggaacaccggtggcgaaggcgggtctctgggccgtaactgacgctgaggagcgaaagcgtgggtagcgaacagg

SEQ ID NO: 424 - DNA, 253 bp, Unknown
  Description of Unknown: bacterium polynucleotide
  Actinobacteria
tacggagggtgcgagcgttgtccggattcattgggcgtaaagagctcgtaggcggctgttcaagtcgaacgtgaaaactcggggctcaactccgagcctgcgttcgatactggatggctagagtctggtagggggatctggaattcctggtgtagcggtggaatgcgcagatatcaggaggaacaccggtggcgaaggcgggatcctgggccagtactgacgctgaggagcgaaagcgtggggagcaaacagg

SEQ ID NO: 425 - DNA, 253 bp, Unknown
  Description of Unknown: bacterium polynucleotide
  Actinobacteria
tacggagggtgcgagcgttgtccggaatcactgggcgtaaagggcgcgtaggcggcgcgagaagtcaacggtgaaagctcggggctcaactccgagtcggccgtcgatactcttgtgctcgagcactgtagaggcagatggaattccgggtgtagcggtgaaatgcgcagatatcaggaggaacaccggtggcgaaggcggttctctgggcattacctgacgctgaggagcgaaagtgtggggagcgaacagg

SEQ ID NO: 426 - DNA, 253 bp, Unknown
  Description of Unknown: bacterium polynucleotide
  Actinobacteria
tacgcagggtgcgagcgttgtccggatttattgggcgtaaagagcttgtaggcggctcgtcacgtcgggtgtgaaaactcgcggctcaaccgcgagcctgcacccgatacgggcgggctagagttcggcaggggagactggaattcctggtgtagcggtggaatgcgcagatatcaggaggaacaccggtggcgaaggcgggtctctgggccgatactgacgctgagaagcgaaagcgtggggagcgaacagg

SEQ ID NO: 427 - DNA, 253 bp, Unknown
  Description of Unknown: bacterium polynucleotide
  Actinobacteria
tacgtagggtgcaagcgttgtccggaattattgggcgtaaagagctcgtaggcggtttgtcgcgtctgctgtgaaaatccagggcttaaccctggacctgcagtgggtacgggcagactagagtgcggtaggggagatcggaattcctggtgtagcggtgaaatgcgcagatatcaggaggaacaccggtggcgaaggcggatctctgggccgtaactgacgctgaggagcgaaagcatggggagcgaacagg

SEQ ID NO: 428 - DNA, 253 bp, Unknown
  Description of Unknown: bacterium polynucleotide
  Actinobacteria
cacgtagggcgcaagcgttgtccggaattattgggcgtaaagagctcgtaggtggcccgccacgtccgctgtgaaaatccagggcttaaccctggacttgcagtggatacgggcgggctagaggtaggtaggggagaatggaattcccggtgtagcggtgaaatgcgcagatatcgggaggaacaccggtggcgaaggcggttctctgggccttacctgacactgaggagcgaaagcgtggggagcgaacagg

SEQ ID NO: 429 - DNA, 253 bp, Unknown
  Description of Unknown: bacterium polynucleotide
  Actinobacteria
tacgtagggtgcaagcgttgtccggatttattgggcgtaaagagctcgtaggcggttagtcacgtcggatgtgaaaacccagagcttaactctgggcctgcattcgatacgggctgactagagtgttgtaggggagactggaactcctggtgtagcggtgaaatgcgcagatatcaggaagaacaccggtggcgaaggcgggtctctgggcaactactgacgctgaggagcgaaagcgtggggagcaaacagg

SEQ ID NO: 430 - DNA, 253 bp, Unknown
  Description of Unknown: bacterium polynucleotide
  Actinobacteria
tacgtagggtgcaagcgttgtccggaattattgggcgtaaagagctcgtaggcggtttgtcgcgtcggctgtgaaaacttggggcttaactccgagcgtgcagtcgatacgggcagacttgagtatggcaggggagactggaattcctggtgtagcggtgaaatgcgcagatatcaggaggaacaccggtggcgaaggcgggtctctgggccattactgacgctgaggagcgaaagcatggggagcgaacagg

SEQ ID NO: 431 - DNA, 255 bp, Unknown
  Description of Unknown: bacterium polynucleotide
  Actinobacteria
cacgtagggcgcaagcgttgtccggaattattgggcgtaaagagctcgtaggtggcctgttgcgtccgctgtgaaaactcagggcttaaccctgagccggcagtggatacgggcaggctagaggtaggtaggggagaatggaattcctggtgtagcggtgaaatgcgcagatatccggaagaacaccggtggcgaaggcggcctgctgggcagttttgctgacactgaggcgcgacagcgtggggagcaaacagg

SEQ ID NO: 432 - DNA, 253 bp, Unknown
  Description of Unknown: bacterium polynucleotide
  Actinobacteria
tacgtagggtgcgagcgttgtccggaattattgggcgtaaagagcttgtaggtggctcgttgcgtcgggagtgaaaacccgcggcttaaccgcgggcctgcttccgatacgggcgagctagagttcggcaggggagactggaattcctggtgtagcggtggaatgcgcagatatcaggaggaacaccggtggcgaaggcggatctctgggccgatactgacactgagaagcgaaagcgtggggagcgaacagg

SEQ ID NO: 433 - DNA, 253 bp, Unknown
  Description of Unknown: bacterium polynucleotide
  Actinobacteria
tacgtagtgtgcaagcgttgtccggaattattgggcgtaaagagctcgtaagcggcttgtcgcgtcgactgtgaaaacccagggctcaaccctgggcctgcagtcgatacgggcaggctagagtgcggtaggggagactggaattcctggtgtagcggtgaaatgcgcagatatcaggaggaacaccggtggcgaaggcgggtctctgggccgtaactgacgctgaggagcgaaagcgtggggagcgaacagg

SEQ ID NO: 434 - DNA, 253 bp, Actinomyces sp.
  Actinobacteria; Actinomycetaceae; Actinomyces
tacgtagggcgcgagcgttgtccggaattattgggcgtaaagggcttgtaggcggttggtcgcgtctgccgtgaaattctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacagg

SEQ ID NO: 435 - DNA, 253 bp, Actinomyces sp.
  Actinobacteria; Actinomycetaceae; Actinomyces
tacgtagggcgcgagcgttgtccggaattattgggcgtaaggagctcgtaggcggctggtcgcgtctgtcgtgaaatcctctggcttaactgggggcttgcggtgggtacgggcctgcttgagtgcggtaggggagactggaactcctggtgtagcggtggaatgcgcagatatcaggaagaacaccggtggcgaaggcgggtctctgggccgttactgacgctgaggagcgaaagcgtggggagcgaacagg

SEQ ID NO: 436 - DNA, 253 bp, Actinomyces sp.
  Actinobacteria; Actinomycetaceae; Actinomyces
tacgtagggcgcgagcgttgtccggaattactgggcgtaaagggcttgtaggcggcttgccgcgtctgccgtgaaatcctctggcttaactgggggcgtgcggtgggtacgggctggcttgagtgcggtaggggagactggaattcctggtgtagcggtggaatgcgcagatatcaggaggagcaccggtggcgaaggcgggtctctgggccgttactgacgctgaggagcgaaagcgtggggagcgaacagg

SEQ ID NO: 437 - DNA, 253 bp, Actinomyces sp.
  Actinobacteria; Actinomycetaceae; Actinomyces
tacgtagggcgcgagcgttgtccggaattattgggcgtaaagggcttgtaggcggcttgtcgcgtctgccgtgaaatcctggggcttaaccttgggcttgcggtgggtacgggctggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacagg

SEQ ID NO: 438 - DNA, 253 bp, Unknown
  Description of Unknown: bacterium polynucleotide
  Actinobacteria; Actinomycetaceae; N09
tacgtagggcgcgagcgttgtccggatttattgggcgtaaagagctcgtaggcggtttgtcgcgtctgccgtgaaatttcctggcttaactgggagcgtgcggtgggtacgggcagactggagtgcggtaggggagactggaattcctggtgtagcggtggaatgcgcagatatcaggaggaacaccggtggcgaaggcgggtctctgggccgttactgacgctgaggagcgaaagcatggggagcgaacagg

SEQ ID NO: 439 - DNA, 253 bp, Varibaculum sp.
  Actinobacteria; Actinomycetaceae; Varibaculum
tacgtagggcgcgagcgttgtccggaattattgggcgtaaagggcttgtaggtggctggttgcgtctgtcgtgaaagctcatggcttaactgtgggtttgcggtgggtacgggctggcttgagtgcagtaggggaggctggaattcctggtgtagcggtggaatgcgcagatatcaggaggaataccggtggcgaaggcgggtctctgggctgttactgacactgaggagcgaaagcatggggagcgaacagg

SEQ ID NO: 440 - DNA, 253 bp, Unknown
  Description of Unknown: bacterium polynucleotide
  Actinobacteria; Actinospicaceae
tacgtagggtgcgagcgttgtccggatttattgggcgtaaagggctcgtaggcggcgtgtcgcgtcgggagtgaaagcccaccgcttaacagtgggtctgcttccggtacgggcgtgctggagtgtggcaggggagactggaattcctggtgtagcggtggaatgcgcagatatcaggaggaacacctgtggtgtagacagcttactggaccatgactgacgctgaggcacgaaagcgtgggtagcaaacggg

SEQ ID NO: 441 - DNA, 253 bp, Unknown
  Description of Unknown: bacterium polynucleotide
  Actinobacteria; Actinospicaceae
tacgtagggtgcgagcgttaatcggaattactgggcgtaaagggctcgtaggcggcctgtcgcgtcgggagtgaaagcccactgcttaacggtgggtctgcttccggtacgggcgggctggagtatggcaggggagactggaattcctagtgtagcggtggaatgcgcagatatcaggaggaacaccggtggcgaaggcgggtctctgggccgatactgacactgagaagcgaaagcgtggggagcgaacagg

SEQ ID NO: 442 - DNA, 253 bp, Unknown
  Description of Unknown: bacterium polynucleotide
  Actinobacteria; Actinosynnemataceae
tacgtagggtgcgagcgttgtccggaattattgggcgtaaagagctcgtaggcggtttgtcgcgtcggccgtgaaaacttggggcttaaccccgagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 443 - DNA, 253 bp, Unknown
  Description of Unknown: bacterium polynucleotide
  Actinobacteria; Actinosynnemataceae
tacgtagggtgcgagcgttgtccggaattattgggcgtaaagagctcgtaggcggtttgttgcgtcggctgtgaaaacctacagcttaactgtgggcctgcagtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 444 - DNA, 253 bp, Lentzea sp.
  Actinobacteria; Actinosynnemataceae; Lentzea
tacgtagggcgcaagcgttatccggaattattgggcgtaaagagctcgtaggcggtttgtcgcgtcggccgtgaaaacttggggcttaaccccaagcttgcggtcgatacgggcagacttgagttcggcaggggagactggaattcctggtgtagcggtgaaatgcgcagatatcaggaggaacaccggtggcgaaggcgggtctctgggccgacactgacgctgaggagcgaaagcgtggggatcaaacagg

SEQ ID NO: 445 - DNA, 253 bp, Lentzea albidocapillata
  Actinobacteria; Actinosynnemataceae; Lentzea albidocapillata
tacgtagggtgcgagcgttgtccggaattattgggcgcaaagagctcgtaggcggtttgtcgcgtcggccgtgaagacttggggcttaactccaagcttgcggtcgatacgggcagacttgagttcggcaggggagactggaattcctggtgtagcggtgaaatgcgcagatatcaggaggaacaccggtggcgaaggcgggtctctgggccgacactgacgctgaggagcgaaagcatggggagcaaacagg

SEQ ID NO: 446 - DNA, 253 bp, Lentzea albidocapillata
  Actinobacteria; Actinosynnemataceae; Lentzea albidocapillata
tgcgaagggggctagcgttgctcggaattactgggcgtaaagagctcgtaggcggtttgtcgcgtcggccgtgaaaacttggggcttaaccccaagcttgcggtcgatacgggcagacttgagttcggcaggggagactggaattcctggtgtagcggtgaaatgcgcagatatcaggaggaacaccggtggcgaaggcgggtctctgggccgacactgacgctgaggagcgaaagcgtggggagcgaacagg

SEQ ID NO: 447 - DNA, 253 bp, Bifidobacterium sp.
  Actinobacteria; Bifidobacteriaceae; Bifidobacterium
tacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacagg

SEQ ID NO: 448 - DNA, 253 bp, Brevibacterium sp.
  Actinobacteria; Brevibacteriaceae; Brevibacterium
tacgtagggtacaagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacagg

SEQ ID NO: 449 - DNA, 253 bp, Brevibacterium paucivorans
  Actinobacteria; Brevibacteriaceae; Brevibacterium paucivorans
tacgtagggtactagcgttgtccggaattattgggcgtaaagagctcgtaggtggtttgtcgcgtctgctgtggaaacgtgccgcttaacggtgcgcgtgcagtgggtacgggcggactagagtgcagtaggggagtctggaattcctggtgtagcggtgaaatgcgcagatatcaggaggaacaccggtggcgaaggcgggactctgggctgttactgacgctgaggagcgaaagcatggggagcgaacagg

SEQ ID NO: 450 - DNA, 253 bp, Cellulomonas xylanilytica
  Actinobacteria; Cellulomonadaceae; Cellulomonas xylanilytica
tacgtagggcgcaagcgttgcccggaattattgggcgtaaagagctcgtaggcggtttgtcgcgtctgctgtgaaaacctaaggctcaaccttgggcttgcagtgggtacgggcagactagagtgcggtaggggtgactggaattcctggtgtagcggtggaatgcgcagatatcaggtggaacaccgatggcgaaggcaggtcactgggccgcaactgacgctgaggagcgaaagcatggggagcgaacagg

SEQ ID NO: 451 - DNA, 253 bp, Cellulomonas sp.
  Actinobacteria; Cellulomonadaceae; Cellulomonas
tacgtagggcgcaagcgttgtccggaattattgggcgtaaagagctcgtaggcggttagtcgcgtctgctgtgaaaactcgaggctcaacctcgggcttgcagtgggtacgggctgactagagtgcggtaggggtgactggaattcctggtgtagcggtggaatgcgcagatatcaggaggaacaccgatggcgaaggcaggtcactgggccgcaactgacgctgaggagcgaaagcatggggagcgaacagg

SEQ ID NO: 452 - DNA, 254 bp, Corynebacterium sp.
  Actinobacteria; Corynebacteriaceae; Corynebacterium
tacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacagg

SEQ ID NO: 453 - DNA, 254 bp, Corynebacterium sp.
  Actinobacteria; Corynebacteriaceae; Corynebacterium
tacgtagggtgcgagcgttgtccggaattactgggcgtaaagagctcgtaggtggtttgtcgcgtcgtttgtgtaagtccacggcttaactgtgggatggcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacagg

SEQ ID NO: 454 - DNA, 254 bp, Corynebacterium sp.
  Actinobacteria; Corynebacteriaceae; Corynebacterium
tacgtagggtgcgagcgttgtcaggaattactgggcgtaaagagctcgtaggtggtttgttgcgtcgtctgtgaaattccggggcttaacttcggggtggcaggcgatacgggcataactagagtgctgtaggggagactggaattcctggtgtagcggtggaatgcgcagatatcaggaggaacaccgatggcgaaggcaggtctctgggcagtaactgacgctgaggagcgaaagcatggggagcgaacagg

SEQ ID NO: 455 - DNA, 253 bp, Corynebacterium sp.
  Actinobacteria; Corynebacteriaceae; Corynebacterium
tacgtagggtgcgagcgttgtccggaattactgggcgtaaagagctcgtaggtggtttgtcgcgtcgtctgtgaaatcccgaggcttaacttcgggcgtgcaggcgatacgggcaagctggagtgctgtaggggagactggaattcctggtgtagcggtggaatgcgcagatattaggaagaacaccgatggcgaaggcaggtctctgggcagtaaccgacactgaggagcgaaagcatgggtagcgaacagg

SEQ ID NO: 456 - DNA, 254 bp, Corynebacterium sp.
  Actinobacteria; Corynebacteriaceae; Corynebacterium
tacgtagggtgcgagcgctgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatacgcagatatcaggaggaacaccgatggcgaaggcaggtctctgggcagtaactgacgctgaggagcgaaagcatgggtagcgaacagg

SEQ ID NO: 457 - DNA, 254 bp, Corynebacterium sp.
  Actinobacteria; Corynebacteriaceae; Corynebacterium
tacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacagg

SEQ ID NO: 458 - DNA, 253 bp, Corynebacterium sp.
  Actinobacteria; Corynebacteriaceae; Corynebacterium
tacgtagggtgcaagcgttgtccggaattactgggcgtaaagagctcgtaggtggtttgtcgcgtcgtctgtgaaattccggggcttaactccgggcgtgcaggcgatacgggcaaactggagtgctgtaggggagactggaattcctggtgtagcggtggaatgcgcagatatcaggaggaacaccgatggcgaaggcaggtctctgggcagttactgacactgaggagcgaaagcatgggtagcgaacagg

SEQ ID NO: 459 - DNA, 253 bp, Corynebacterium sp.
  Actinobacteria; Corynebacteriaceae; Corynebacterium
tacgtagggtgcgagcgttgtccggaattactgggcgtaaagagctcgtaggcggtttgtcacgtcgtctgtgaaatcctagggcttaaccctggacgtgcaggcgatacgggctgacttgagtactacaggggagactggaatttctggtgtagcggtggaatgcacagatatcaggaagaacaccgatggcgaaggcaggtctctgggtagtaactgacgctgaggagcgaaagcatgggtagcgaacagg

SEQ ID NO: 460 - DNA, 254 bp, Corynebacterium durum
  Actinobacteria; Corynebacteriaceae; Corynebacterium durum
tacgtagggtgcaagcgttgtccggatttactgggcgtaaagagctcgtaggtggtgtgtcgcgtcgtctgtgaaattccggggcttaactccgggcgtgcaggcgatacgggcacgactagagtgctgtaggggtaactggaattcctggtgtagcggtgaaatgcgcagatatcaggaggaacaccgatggcgagggcaggttactgggcagttactgacgctgaggagcgaaagcatggggagcgaacagg

SEQ ID NO: 461 - DNA, 254 bp, Corynebacterium stationis
  Actinobacteria; Corynebacteriaceae; Corynebacterium stationis
tacgtagggtgcaagcgttgtccggaattactgggcgtaaagagctcgtaggtggtttgtcgcgtcgtctgtgaaatcccgggtctcaacttcgggcgtgcaggcgatacgggcataacttgagtgctgtaggggagactggaattcctggtgtagcggtgaaatgcgcagatatcaggaggaacaccgatggcgaaggcaggtctctgggccattactgacactgaggagcgaaagcatgggtagcgaacagg

SEQ ID NO: 462 - DNA, 254 bp, Corynebacterium kroppenstedtii
  Actinobacteria; Corynebacteriaceae; Corynebacterium kroppenstedtii
tacgtagggtgcgagcgttgttcggaattactgggcgtaaagagctcgtaggtggtctgtcgcgtcatttgtgaaagcccggggcttaactccgggttggcaggtgatacgggcatgactggagtactgtaggggagactggaattcctggtgtagcggtgaaatgcgcagatatcaggaggaacaccggtggcgaaggcgggtctctgggcagtaactgacgctgaggagcgaaagcatgggtagcgaacagg

SEQ ID NO: 463 - DNA, 254 bp, Corynebacterium sp.
  Actinobacteria; Corynebacteriaceae; Corynebacterium
tacgtagggtgcgagcgttgtccggaattactgggcgtaaagagctcgtaggtggtttgtcgcgtcgtgtgtgaaattccggggcttaacttcggggttgcatacgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacagg

SEQ ID NO: 464 - DNA, 253 bp, Corynebacterium sp.
  Actinobacteria; Corynebacteriaceae; Corynebacterium
tacgtagggtgcgagcgttgtccggaattactgggcgtaaagagctcgtaggtggtttgtcgcgtcgtctgtgaaagtccagcgcttaacgctgggattgcaggcgatacgggcttacttgagtgctgtaggggagactggaattcctggtgtagcggtgaaatgcgcagatatcaggaggaacaccaatggcgaaggcaggtctctgggcagtcactgacactgaggagcgaaagcatgggtagccaacagg

SEQ ID NO: 465 - DNA, 253 bp, Unknown
  Description of Unknown: bacterium polynucleotide
  Actinobacteria; Dermabacteraceae
tacgtagggcgcaagcgttgtccggaattattgggcgtaaagagcttgtaggtggcttgtcgcgtctgccgtgaaaacccaacgcttaacgttgggcgtgcggtgggtacgggctggctagagtgtggtaggggagattggaattcctggtgtagcggtgaaatgcgcagatatcaggaggaacaccgatggcgaaggcaggtctctgggccattactgacactgagaagcgaaagcatggggagcgaacagg

SEQ ID NO: 466 - DNA, 253 bp, Dermacoccus sp.
  Actinobacteria; Dermacoccaceae; Dermacoccus
tacgtagggtgcgagcgttgtccggaattattgggcgtaaagagcttgtaggcggtttgtcgcgtctgccgtgaaagcccagggcttaaccctgggtctgcggtgggtacgggcaggctagagtgtggtaggggagactggaattcctggtgtagcggtgaaatgcgcagatatcaggaggaacaccgatggcgaaggcaggtctctgggccactactgacgctgagaagcgaaagcatggggagcgaacagg

SEQ ID NO: 467 - DNA, 253 bp, Dermacoccus sp.
  Actinobacteria; Dermacoccaceae; Dermacoccus
tacgtagggtgcgagcgttgtccggaattattgggcgtaaagagcttgtaggcggtttgtcgcgtctgctgtgaaaattcggggcttaactccggacgtgcagtgggtacgggcaggctagagtgtggtaggggagactggaattcctggtgtagcggtgaaatgcgcagatatcaggaggaacaccgatggcgaaggcaggtccctgggccataactgacgctgagaagcgaaagcatggggagcgaacagg

SEQ ID NO: 468 - DNA, 253 bp, Dermacoccus sp.
  Actinobacteria; Dermacoccaceae; Dermacoccus
tacgtagggggcaagcgttgtccggaattattgggcgtaaagagcttgtaggcggcttgtcgcgtctgctgtgaaagcccggggcttaactccgggtctgcagtgggtacgggcaggctagagtgtggtaggggagactggaattcctggtgtagcggtgaaatgcgcagatatcaggaagaacaccgatggcgaaggcaggtctctgggccactactgacgctgagaagcgaaagcatggggagcgaacagg

SEQ ID NO: 469 - DNA, 253 bp, Unknown
  Description of Unknown: bacterium polynucleotide
  Actinobacteria; Frankiaceae
tacgtagggtgcaagcgttgtccggaattattgggcgtaaagagctcgtaggcggttcgtcacgtcggctgtgaaaacctggggctcaactccgggcctgcagccgatacgggcggactagaattcggtaggggagactggaattcctggtgtagcggtgaaatgcgcagatatcaggaggaacaccggtggcgaaggcgggtctctgggccgatattgacgctgaggagcgaaagcgtggggagcgaacagg

SEQ ID NO: 470 - DNA, 253 bp, Unknown
  Description of Unknown: bacterium polynucleotide
  Actinobacteria; Frankiaceae
tacgtagggtgcaagcgttgtccggaattattgggcgtaaagagctcgtaggcggtttgtcgcgtcggctgtgaaaactcggggctcaaccccgagcctgcagtcgatacgggcaaactagagtgtggtaggggagactggaattcctggtgtagcggtgaaatgcgcagatatcaggaggaacaccggcggcgaaggcgggtctctgggccataactgacgctgaggagcgaaagcgtggggagcgaacagg

SEQ ID NO: 471 - DNA, 253 bp, Unknown
  Description of Unknown: bacterium polynucleotide
  Actinobacteria; Frankiaceae
tacgtagggtgcaagcgttgtccggaattattgggcgtaaagagctcgtaggcggcttgttacgtcgactgtgaaaacctggggctcaaccccgggcctgcagtcgatacgggcaagctagaattcggtaggggagactggaattcctggtgtagcggtgaaatgcgcagatatcaggaggaacaccggtggcgaaggcgggtctctgggccgatattgacgctgaggagcgaaagcgtggggagcgaacagg

SEQ ID NO: 472 - DNA, 253 bp, Kaistibacter ginsenosidimutans
  Actinobacteria; Frankiaceae; Kaistibacter ginsenosidimutans
tacgcagggtgcaagcgttgtccggaattattgggcgtaaagagctcgtaggcggtctgtcgcgtcagctgtgaaaacctggggctcaaccccgggcctgcagccgatacgggcagactagaattcggtaggggagactggaattcctggtgtagcggtgaaatgcgcagatatcaggaggaacaccggtggcgaaggcgggtctctgggccgatattgacgctgaggagcgaaagcgtggggagcaaacagg

SEQ ID NO: 473 - DNA, 253 bp, Unknown
  Description of Unknown: bacterium polynucleotide
  Actinobacteria; Geodermatophilaceae
tacgtagggtgcaagcgttgtccggaattattgggcgtaaagagctcgtaggcggtttgtcgcgtcggctgtgaaagcccggagctcaactccgggtctgcagtcgatacgggcagacttgagtgttgcaggggagactggaattcctggtgtagcggtgaaatgcgcagatatcaggaggaacaccggtggcgaaggcgggtctctgggcaacaactgacgctgaggagcgaaagcgtggggagcgaacagg

SEQ ID NO: 474 - DNA, 253 bp, Unknown
  Description of Unknown: bacterium polynucleotide
  Actinobacteria; Geodermatophilaceae
tacgtagggtgcaagcgttgtccggaattattgggcgtaaagagctcgtaggcggtttgttgcgtcggctgtgaaaacctgaggctcaacctcaggactgcagtcgatacgagcagactagagtgttgcaggggagactggaattcctggtgtagcggtgaaatgcgcagatatcaggaggaacaccggtggcgaaggcgggtctctgggcaacaattgacgctgaggagcgaaagcgtggggagcgaacagg

SEQ ID NO: 475 - DNA, 252 bp, Unknown
  Description of Unknown: bacterium polynucleotide
  Actinobacteria; Geodermatophilaceae
tacgtagggtgcaagcgttgtccggaattattgggcgtaaagagctcgtaggcggttcgtcgcgtcggctgtgaagtcccgaggctcaacctcgggtctgcagtcgatacgggcggactggagttcggcaggggagactggaattcctgtgtagcagtgaaatgcgcagatatcgggaggaacaccggtggcgaaggcgggtctctgggccgatactgacgctgaggagcgaaagcgtggggagcgaacagg

SEQ ID NO: 476 - DNA, 253 bp, Unknown
  Description of Unknown: bacterium polynucleotide
  Actinobacteria; Geodermatophilaceae
tacgtagggtgcaagcgttgtccggaattattgggcgtaaagagctcgtaggcggtttgttgcgtcggctgtgaaatcccgaggctcaacctcgggtctgcagtcgatacgagcaaactagagtgttgcaggggagactggaattcctggtgtagcggtgaaatgcgcagatatcagggggaacaccggtggcgaaggcgggtctctgggcagcaactgacgctgaggagcgaaagcgtggggagcgaacagg

SEQ ID NO: 477 - DNA, 253 bp, Unknown
  Description of Unknown: bacterium polynucleotide
  Actinobacteria; Geodermatophilaceae
tacggaggatccaagcgttatccggaatcattgggcgtaaagagctcgtaggcggtttgttgcgtcggctgtgaaatcccgaggctcaacctcgggtctgcagtcgatacgagcaaactagagtgttgcaggggagactggaattcctggtgtagcggtgaaatgcgcagatatcaggaggaacaccgatggcgaaggcaggtctctgggcagttactgacgctgaggagtgaaagcgtggggagcaaacagg

SEQ ID NO: 478 - DNA, 253 bp, Geodermatophilus sp.
  Actinobacteria; Geodermatophilaceae; Geodermatophilus
tacgtagggtgcaagcgttgtccggaattattgggcgtaaagagctcgtaggcggttcgtcgcgtcggctgtgaaaacccggagctcaactccgggcctgcagtcgatacgggcggacttgagttcggtaggggagactggaattcctggtgtagcggtgaaatgcacagatatcaggaggaacaccggtggcgaaggcgggtctctgggccgatactgacgctgaggagcgaaagcgtggggagcgaacagg

SEQ ID NO: 479 - DNA, 253 bp, Modestobacter sp.
  Actinobacteria; Geodermatophilaceae; Modestobacter
tacgtagggtgcaggcgttgtccggaattattgggcgtaaagagctcgtaggcggtctgtcgcgtcggttgtgaaaacccggagctcaactccgggcctgcagtcgatacgggcaaactggagtgttgcaggggagactggaattcctggtgtagcggtgaaatgcgcagatatcaggaggaacaccggtggcaaaggcgggtctctgggcaacaactgacgctgaggagcgaaagcgtggggagcgaacagg

SEQ ID NO: 480 - DNA, 253 bp, Modestobacter sp.
  Actinobacteria; Geodermatophilaceae; Modestobacter
tacgtagggtgcaagcgttgtccggaattattgggcgtaaagagctcgtaggcggtctgtcgcgtcggctgtgaaaacccgaggctcaacctcgggcctgcagtcgatacgggcaaactggagtactgcaggggagactggaattcctggtgtagcggtgaaatgcgcagatatcaggaggaacaccgatggcgaaggcaggtctctgggcagttactgacgctgaggagcgaaagcatggggagcgaacagg

SEQ ID NO: 481 - DNA, 253 bp, Glycomyces sp.
  Actinobacteria; Glycomycetaceae; Glycomyces
gacgtagggcgcgagcgttgtccggatttattgggcgtaaagggctcgtaggcggttgattgcgtccgccgtgaaaggcctcggcttaaccggggttttgcggtggatacgggtcgacttgaggcaattaggggagatcggaattctacgtgtagcggtgaaatgcgcagatatgtggaggaacaccggtggcgaaggcggatctctgggattgttctgacgctgaggagcgaaagcgtggggagcgaacagg

SEQ ID NO: 482 - DNA, 253 bp, Gordonia sp.
  Actinobacteria; Gordoniaceae; Gordonia
tacgtagggtgcaagcgttgtccggaattactgggcgtaaagagcccgtaggcggtttgtcgcgtcgtctgtgaaattctgcagcttaactgtaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacagg

SEQ ID NO: 483 - DNA, 253 bp, Unknown
  Description of Unknown: bacterium polynucleotide
  Actinobacteria; Intrasporangiaceae
tacgtagggtgcgagcgttgtccggaattattgggcgtaaagagcttgtaggcggtttgtcgcgtctgctgtgaaaatctggggcttaaccctggacgtgcagtgggtacgggcagactagagtgtggtaggggagactggaattcctggtgtagcggtggaatgcgcagatatcaggaggaacaccgatggcgaaggcaggtctctgggccattactgacgctgagaagcgaaagcatggggagcgaacagg

SEQ ID NO: 484 - DNA, 253 bp, Phycicoccus sp.
  Actinobacteria; Intrasporangiaceae; Phycicoccus
tacgtagggtgcgagcgttgtccggaattattgggcgtaaagagcttgtaggcggtttgtcgcgtctgccgtgaaatttcgaggctcaacctcgaacttgcggtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacagg

SEQ ID NO: 485 - DNA, 253 bp, Phycicoccus sp.
  Actinobacteria; Intrasporangiaceae; Phycicoccus
tacgtagggtgcgagcgttgtccggaattattgggcgtaaagggcttgtaggcggtttgccgcgtctgctgtgaaaatccgaggctcaacctcggacttgcagtgggtacgggcagactagagtgtggtaggggagactggaattcctggtgtagcggtgaaatgcgcagatatcaggaggaacaccgatggcgaaggcaggtatctgggccactactgacgctgagaagcgaaagcatggggagcgaacagg

SEQ ID NO: 486 - DNA, 253 bp, Terracoccus sp.
  Actinobacteria; Intrasporangiaceae; Terracoccus
tacgtagggtgcgagcgttgtccggaatcattgggcgtaaagagcttgtaggtggtttgtcgcgtctgctgtgaaaatccgaggctcaacctcggacttgcagtgggtacgggcagactagagtgtggtaggggagactggaattcctggtgtagcggtggaatgcgcagatatcaggaggaacaccgatggcgaaggcaggtctctgggccattactgacactgagaagcgaaagcatggggagcgaacagg

SEQ ID NO: 487 - DNA, 253 bp, Unknown
  Description of Unknown: bacterium polynucleotide
  Actinobacteria; Kineosporiaceae
tacgtagggtgcaagcgttgtccggaattattgggcgtaaagagctcgtaggcggtctgtcgcgtctgctgtgaaaactcagggcttaaccctgagcttgcagtgggtacgggcagactagagtgcggtaggggagactggaattcctggtgtagcggtgaaatgcgcagatatcaggaggaacaccggtggcgaaggcgggtctctgggccgtaactgacgctgaggagcgaaagcatggggagcgaacagg

SEQ ID NO: 488 - DNA, 253 bp, Unknown
  Description of Unknown: bacterium polynucleotide
  Actinobacteria; Kineosporiaceae
tacgtagggtgcaagcgttgtccggaattattgggcgtaaagagctcgtaggcggtttgtcgcgtccgctgtgaaaactcggggcttaaccccgggcctgcagtgggtacgggcagactagagtgcggtaggggaggctggaattcctggtgtagcggtgaaatgcgcagatatcaggaggaacaccggtggcgaaggcgggtctctgggccgtaactgacgctgaggagcgaaagcgtggggagcgaacagg

SEQ ID NO: 489 - DNA, 253 bp, Kineococcus sp.
  Actinobacteria; Kineosporiaceae; Kineococcus
tacgtagggtgcaagcgttgtccggaattattgggcgtaaagagctcgtaggcggtgtgtcgcgtctgctgtgaaaactcagggctcaactctgagcttgcagtgggtacgggcacacttgagtgctgtaggggagactggaattcctggtgtagcggtgaaatgcgcagatatcaggaggaacaccggtggcgaaggcgggtctctgggcagttactgacgctgaggagcgaaagcatggggagcgaacagg

SEQ ID NO: 490 - DNA, 253 bp, Quadrisphaera granulorum
  Actinobacteria; Kineosporiaceae; Quadrisphaera granulorum
tacgtagggtgcaagcgttgtccggaattattgggcgtaaagagctcgtaggcggtttgtcgcgtctgctgtgaaaacgcggggctcaactccgcgcctgcagtgggtacgggcagactagagtgcagtaggggagactggaattcctggtgtagcggtggaatgcgcagatatcaggaggaacaccggtggcgaaggcgggtctctgggctgtaactgacgctgaggagcgaaagcgtgggtagcgaacagg

SEQ ID NO: 491 - DNA, 253 bp, Unknown
  Description of Unknown: bacterium polynucleotide
  Actinobacteria; Microbacteriaceae
tacgtagggtgcaagcgttgtccggaattattgggcgtaaagagctcgtaggcggtttgtcgcgtctgctgtgaaaacccggggctcaacctcgggcctgcagtgagtacgggcagactagagtgcggtaggggagaatggaattcctggtgtagcggtggaatgcgcagatatcaggaggaacaccgatggcgaaggcagttctctgggccgtaactgacgccgaggagcgaaagcgtggggagcaaacagg

SEQ ID NO: 492 - DNA, 253 bp, Unknown
  Description of Unknown: bacterium polynucleotide
  Actinobacteria; Microbacteriaceae
tacgtagggtgcaagcgttgtccggaattattgggcgtaaagggctcgtaggcggtttgtcgcgtctgctgtgaaatcccgaggctcaacctcgggtctgcagtgggtacgggcagactagagtgtggtaggggagattggaattcctggtgtagcggtggaatgcgcagatatcagggggaacaccgatggcgaaggcagatctctgggccattactgacgctgaggagcgaaagcatggggagcgaacagg

SEQ ID NO: 493 - DNA, 253 bp, Unknown
  Description of Unknown: bacterium polynucleotide
  Actinobacteria; Microbacteriaceae
tacgtagggtgcaagcgttatccggaattattgggcgtaaagagctcgtaggcggtttgtcgcgtctgctgtgaaaaccggaggctcaacctccgacctgcagtgggtacgggcaaactagagtgcgataagggagattggaattcctggtgtagcggtggaatgcgcagatatcaggaggaacaccgatggcgaaggcagctctctgggccgtaactgacgctgaggagcgaaagcgtggagagcgaacagg

SEQ ID NO: 494 - DNA, 253 bp, Unknown
  Description of Unknown: bacterium polynucleotide
  Actinobacteria; Microbacteriaceae
tacgtagggtgcaagcgttatccggaattattgggcgtaaagagctcgtaggcggtctgtcgcgtctgctgtgaaatctgggggctcaacccccagcctgcagtgggtacgggcagactaaagtgcggtaggggagattggaactcctggtgtagcggtggaatgcgcagatatcaggaagaacaccgatggcgaaggcagatctctgggccgtaactgacgctgaggagcgaaagcatggggagcgaacagg

SEQ ID NO: 495 - DNA, 253 bp, Agromyces sp.
  Actinobacteria; Microbacteriaceae; Agromyces
tacgtagggtgcgagcgttgtccggagttattgggcgtaaagagctcgtaggcggtttgtcacgtctgctgtgaaatcccgaggctcaacctcgggcctgcagtgggtacgggcagactggagtgcggtaggggagaatggaattcctggtgtagcggtggaatgcgcagatatcaggaggaacaccgatggcgaaggcagttctctgggccgtaactgacgctgaggagcggaagcgtggggagcgaacagg

SEQ ID NO: 496 - DNA, 253 bp, Agromyces sp.
  Actinobacteria; Microbacteriaceae; Agromyces
tacgtagggtccgagcgttgtccggaattattgggcgtagagagctcgtaggcggtttgtcgcgtctgctgtgaaatcccgaggctcaacctcgggcctgcagtgggtacgggcagacttgagtggtgtaggggagactggaattcctggtgtagcggtggaatgcgcagatatcaggaggaacaccgatggcgaaggcaggtctctgggcacttactgacgccgaggagcgaaagcgtggggagcgaacagg

SEQ ID NO: 497 - DNA, 253 bp, Rathayibacter sp.
  Actinobacteria; Microbacteriaceae; Rathayibacter
tacgtagggtgcgagcgttgtccggaattattgggcgtaaagagctcgtaggcggtctgtcgcgtctgctgtgaaaacccgaggctcaacctcgggcctgcagtgggtacgggcagactagagtgcggtaggggagaatggaactcctggtgtagcggtggaatgcgcagatatcaggaagaacaccgatggcgaaggcagttctctgggccgtaactgacgctgaggagcgaaagcgtggggagcgaacagg

SEQ ID NO: 498 - DNA, 253 bp, Yonghaparkia sp.
  Actinobacteria; Microbacteriaceae; Yonghaparkia
tacgtagggtgcaagcgttgtccggaattattgggcgtaaagagctcgtaggcggtttgtcgcgtctgctgtgaaaacgcgaggctcaacctcgcgcctgcagtgggtacgggcagactagagtgtggtaggggagattggaattcctggtgtagcggtggaatgcgcagatatcaggaggaacaccgatggcgaaggcagatctctgggctattactgacgctgaggagcgaaagcgtggggagcgaacagg

SEQ ID NO: 499 - DNA, 253 bp, Unknown
  Description of Unknown: bacterium polynucleotide
  Actinobacteria; Micrococcaceae
tacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacagg

SEQ ID NO: 500 - DNA, 253 bp, Unknown
  Description of Unknown: bacterium polynucleotide
  Actinobacteria; Micrococcaceae
tacgtagggcgcaagcgttgtccggaattattgggcgtaaagagctcgtaggtggtttgccgcgtctgccgtgaaagcccggggctcaaccccgggtctgcggtgggtacgggcagactggagtgcagtaggggagaccggaattcctggtgtagcggtgaaatgcgcagatatcaggaggaacaccgatggcgaaggcaggtctctgggctgtaactgacgctgaggagcgaaagcatggggagcgaacagg

SEQ ID NO: 501 - DNA, 253 bp, Arthrobacter psychrolactophilus
  Actinobacteria; Micrococcaceae; Arthrobacter psychrolactophilus
tacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 502 - DNA, 253 bp, Arthrobacter sp.
  Actinobacteria; Micrococcaceae; Arthrobacter
tacgtagggcgcaagcgttatccggaattattgggcgtaaagagctcgtaggcggtttgtcgcgtctgccgtgaaagtccggggctcaactccggatctgcggtgggtacgggcaggctagagtgatgtaggggggactggaattcctggtgtagcggtgaaatgcgtagatatcggaaggaacatcagtggcgaaggcggcttactggaccattactgacactgaggcgcgaaagcgtggggagcgaacagg

SEQ ID NO: 503 - DNA, 253 bp, Nesterenkonia sp.
  Actinobacteria; Micrococcaceae; Nesterenkonia
tacgtagggcgcgagcgttatccggaattattgggcgtaaagagctcgtaggcggtttgtcgcgtctgctgtgaaagcccggggcttaaccccgggtgtgcagtgggtacgggcaggctagagtgcagtaggggagactggaattcctggtgtagcggtgaaatgcgcagatatcaggaggaacaccgatggcgaaggcaggtctctgggctgttactgacgctgaggagcgaaagcatggggagcgaacagg

SEQ ID NO: 504 - DNA, 254 bp, Rothia mucilaginosa
  Actinobacteria; Micrococcaceae; Rothia mucilaginosa
tacgtagggcgcgagcgttgtccggaattattgggcgtaaagagcctgtaggcggtttgtcgcgtctgctgtgaaaggccggggcttaaccccgtgtattgcagtgggtacgggcagactagagtgcagtaggggagactggaattcctggtgtagcggtggaatgcgcagatatcaggaggaacaccgatggcgaaggcaggtctctgggctgtaactgacgctgagaagcgaaagcatggggagcgaacagg

SEQ ID NO: 505 - DNA, 253 bp, Unknown
  Description of Unknown: bacterium polynucleotide
  Actinobacteria; Micromonosporaceae
gacgtagggcgcgagcgttgtccggatttattgggcgtaaagagctcgtaggcggcttgtcgcgtcgactgtgaaaacccgcggctcaaccgcgggcctgcagccgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacagg

SEQ ID NO: 506 - DNA, 253 bp, Unknown
  Description of Unknown: bacterium polynucleotide
  Actinobacteria; Micromonosporaceae
gacgtagggcgcgagcgttgtccggatttattgggcgtaaagagctcgtaggcggcttgtcgcgtcgaatgtgaaaacccacagctcaactgtgggcttgcattcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 507 - DNA, 253 bp, Unknown
  Description of Unknown: bacterium polynucleotide
  Actinobacteria; Micromonosporaceae
gacgtagggcgcgagcgttgtccggatttattgggcgtaaagagctcgtaggcggcttgtcgcgtcggctgtgaaatcccgtggctcaactgcgggcttgcagccgatacgggcaggctagagttcggtaggggagactggaattcctggtgtagcggtgaaatgcgcagatatcaggaggaacaccggtggcgaaggcgggtctctgggccgatactgacgctggggagcgaaagcgtggggagcgaacagg

SEQ ID NO: 508 - DNA, 253 bp, Unknown
  Description of Unknown: bacterium polynucleotide
  Actinobacteria; Micromonosporaceae
gacgtagggcgcgagcgttgtccggatttattgggcgtaaagagctcgtaggcggcttgtcgcgtcgaccgtgaaaactcgcagctcaactgcgagcctgcggtcgatacgggcaggctagagttcggtaggggagactggaattcctggtgtagcggcgaaatgcgcagatatcaggaggaacaccgatggcgaaggcaggtctctgggccgatactgacgctgaggagcgaaagcgtggggagcgaacagg

SEQ ID NO: 509 - DNA, 253 bp, Unknown
  Description of Unknown: bacterium polynucleotide
  Actinobacteria; Micromonosporaceae
gacgtggggcgcgagcgttgtccggaattattgggcgtaaagagctcgtaggcggcttgttgcgtcggctgtgaaaacccgcggctcaaccgtgggcttgcagccgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 510 - DNA, 253 bp, Unknown
  Description of Unknown: bacterium polynucleotide
  Actinobacteria; Micromonosporaceae
gacgtagggcgcgagcgttgtccggatttattgggcgtaaagagctcgtaggcggcttgttgcgtcgttcgtgaaatcccgtggctcaactgcgggcttgcggacgatacgggcaggctagaattcggtaggggagactggaattcctggtgtagcggtgaaatgcgcagatatcaggaggaacaccggtggcgaaggcgggtctctgggccgatattgacgctgaggagcgaaagcgtggggggcgaacagg

SEQ ID NO: 511 - DNA, 253 bp, Unknown
  Description of Unknown: bacterium polynucleotide
  Actinobacteria; Micromonosporaceae
gacgtagggcgcgagcgttgtccggatttattgggcgtaaagagctcgtaggcggcttgtcgcgtcgactgtgaaaacccgcggctcaaccgcgggcttgcagtcgatacgggcaggctagagtttggtaggggagactggaattcctggtgtagcggtgaaatgcgcagatatcaggaggaacacaggtggcgaaggcgggtctctgggccaatactgacgctgaggagcgaaagcgtggggagcgaatagg

SEQ ID NO: 512 - DNA, 253 bp, Unknown
  Description of Unknown: bacterium polynucleotide
  Actinobacteria; Micromonosporaceae
gacgtagggcgcgagcgttgtccggatttattgggcgtaaagagctcgtaggcggcttgttgcgtcgtccgtgaaaacctggggctcaactccaggcttgcggtcgatacgggcaggctagagttcggtaggggagactggaattcctggtgtagcggtgaaatgcgcagatatcaggaggaacaccggtggcgaaggcggttctctgggcattacctgacgctgatggacgaaagcgtgggtagcgaacagg

SEQ ID NO: 513 - DNA, 253 bp, Actinoplanes sp.
  Actinobacteria; Micromonosporaceae; Actinoplanes
gacgtagggcgcgagcgttgtccggatttattgggcgtaaagagctcgtaggcggcttgtcgcgtcgaatgtgaaatctcagagctcaactctgacattgcattcgatacgggcaggctggagttcggtaggggagactggaattcctggtgtagcggtgaaatgcgcagatatcaggaggaacaccgatggcgaaggcaggtctctgggccgatactgacgctgaggagcgaaagcgtggggagcgaacagg

SEQ ID NO: 514 - DNA, 253 bp, Actinoplanes sp.
  Actinobacteria; Micromonosporaceae; Actinoplanes
gacgtagggcgcgagcgttgtccggatttattgggcgtaaagagctcgtaggcggcttgtcacgtcgaatgtgaaaactcagggctcaaccctgcgcttgcattcgatacgggcaggctagagttcggtaggggagactggaattcctggtgtagcggtgaaatgcgcagatatcaggaggaacaccgatggcgaaggcaggtctctgggccgatactgacgctgaggagcgagagcgtggggagcgaacagg

SEQ ID NO: 515 - DNA, 253 bp, Actinoplanes sp.
  Actinobacteria; Micromonosporaceae; Actinoplanes
tacgtagggcgcgagcgttgtccggatttattgggcgtaaagagctcgtaggcggcttgtcgcgtcgaatgtgaaaactcggggctcaactccgagcttgcattcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 516 - DNA, 253 bp, Catellatospora sp.
  Actinobacteria; Micromonosporaceae; Catellatospora
gacgtagggcgcgagcgttgtccggatttattgggcgtaaagagctcgtaggcggctcatcgcgtctgccgtgaaaaccagcagcttaactgttggcttgcggttgatacgggtgggctggagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 517 - DNA, 253 bp, Catellatospora sp.
  Actinobacteria; Micromonosporaceae; Catellatospora
gacgtagggcgcgagcgttgtccggatttattgggcgtaaagagctcgtaggcggctcatcgcgtcgtgcgtgaaaacccgtagctcaactgcgggcttgcgttcgatacgggtgggctggagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 518 - DNA, 253 bp, Dactylosporangium sp.
  Actinobacteria; Micromonosporaceae; Dactylosporangium
gacgtagggcgcgagcgttgtccggatttattgggcgtaaagagctcgtaggcggctcgttgcgtcggctgtgaaaacccgcagctcaactgtgggcttgcagctgatacgggcgggctgggattcggtaggggagactggaattcctggtgtagcggtgaaatgcgcagatatcaggaggaacaccggtggcgaaggcgggtctctgggccgatatcgacgctgaggagcgaaagcgtggggagcgaacagg

SEQ ID NO: 519 - DNA, 254 bp, Pilimelia sp.
  Actinobacteria; Micromonosporaceae; Pilimelia
gacgtagggcgcgagcgttgtccggatttattgggcgtaaagagctcgtaggcggcttgttgcgtcgactgtgaaaacccgcggctcaaccgcgtggcttgcagtcgatacgggcaggctagaattcggtaggggagactggaattcctggtgtagcggtgaaatgcgcagatatcaggaggaacaccggtggcgaaggcgggtctctgggccgatattgacgctgaggagcgaaagcgtggggagcgaacagg

SEQ ID NO: 520 - DNA, 253 bp, Virgisporangium ochraceum
  Actinobacteria; Micromonosporaceae; Virgisporangium ochraceum
gacgtagggtgcgagcgttgtccggatttattgggcgtaaagagctcgtaggcggctcgtcgcgtcgaccgtgaaaacccgcagcttaactgcgggcttgcggttgatacgggcgggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 521 - DNA, 253 bp, Mycobacterium sp.
  Actinobacteria; Mycobacteriaceae; Mycobacterium
tacgtagggtccgagcgttgtccggaattactgggcgtaaagagctcgtaggtggtttgtcgcgttgttcgtgaaaactcacagcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 522 - DNA, 253 bp, Mycobacterium sp.
  Actinobacteria; Mycobacteriaceae; Mycobacterium
tacgtagggtgcgagcgttgtccggaattactgggcgtaaagagctcgtaggtggtttgtcgcgttgttcgtgaaaaccgggggcttaactctcggcgtgcgggcgatacgggcagactggagtactgcaggggagactggaattcctggtgtagcggtggaatgcgcagatatcaggaggaacaccggtggcgaaggcgggtctctgggccgatactgacgctgaggagcgatagcgtggggagcgaacagg

SEQ ID NO: 523 - DNA, 253 bp, Mycobacterium celatum
  Actinobacteria; Mycobacteriaceae; Mycobacterium celatum
tacgtagggtgcgagcgttgtccggaattactgggcgtaaagagctcgtaggtggtttgtcgcgttgtccgtgaaattccctggcttaactgggggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 524 - DNA, 253 bp, Mycobacterium sp.
  Actinobacteria; Mycobacteriaceae; Mycobacterium
tacgtagggtccgagcgttgtccggaattactgggcgtaaagagctcgtaggtggtttgtcgcgttgttcgtgaaaactcacagcttaactgtgggcgtgcgggcgatacgggcagacttgagtactgcaggggagactggaattcctggtgtagcggtggaatgcgtagatatcaggaggaacaccggtggcgaaggcggctgcctggcctaagactgacgctgaggtgcgaaagcgtgggtagcgaacggg

SEQ ID NO: 525 - DNA, 253 bp, Unknown
  Description of Unknown: bacterium polynucleotide
  Actinobacteria; Nakamurellaceae
tacgtagggtgcaagcgttgtccggaattattgggcgtaaagagctcgtaggcggtctgtcgcgtcgaatgtgaaaacacgaggctcaacttcgtgcctgcattcgatacgggcagactagagttcggtaggggagtctggaattcctggtgtagcggtgaaatgcgcagatatcaggaggaacaccggtggcgaaggcgggactctgggccgatactgacgctgaggagcgaaagcgtggggagcaaacagg

SEQ ID NO: 526 - DNA, 253 bp, Nocardia sp.
  Actinobacteria; Nocardiaceae; Nocardia
tacgtagggtgcgagcgttgtccggaattactgggcgtaaagagcttgtaggcggtatgtcacgtcttctgtgaaaacttggggctcaaccttaagcttgcaggggatacgggcagactagagtacttcaggggagactggaattcctggtgtagcggtgaaatgcgcagatatcaggaggaacaccggtggcgaaggcgggtctctgggaagtaactgacgctgagaagcgaaagcgtgggtagcaaacagg

SEQ ID NO: 527 - DNA, 253 bp, Nocardia sp.
  Actinobacteria; Nocardiaceae; Nocardia
tacgtagggtgcgagcgttgtccggaattactgggcgtaaagagcttgtaggcggtttgtcgcgtcgattgtgaaaactcacggctcaaccgtgagcttgcagtcgatacgggcagactagagtacttcaggggagactggaattcctggtgtagcggtgaaatgcgcagatatcaggaggaacaccggtggcgaaggcgggtctctgggaagtaactgacgctgagaagcgaaagcgtgggtagcgaacagg

SEQ ID NO: 528 - DNA, 253 bp, Rhodococcus fascians
  Actinobacteria; Nocardiaceae; Rhodococcus fascians
tacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacagg

SEQ ID NO: 529 - DNA, 253 bp, Rhodococcus sp.
  Actinobacteria; Nocardiaceae; Rhodococcus
tacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacagg

SEQ ID NO: 530 - DNA, 253 bp, Rhodococcus sp.
  Actinobacteria; Nocardiaceae; Rhodococcus
tacgtagggtgcgagcgttgtccggaattactgggcgtaaagagttcgtaggcggtttgtcacgtcgtctgtgaaaacccaccgctcaacggtgggcctgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcaaacagg

SEQ ID NO: 531 - DNA, 253 bp, Segniliparus rotundus
  Actinobacteria; Nocardiaceae; Segniliparus rotundus
tacgtagggtgcgagcgttgttcggaattactgggcgtaaagagctcgtaggcggactgtcgcgtcgcctgtgaaagcccgtggctcaaccacgggtctgcaggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 532 - DNA, 253 bp, Unknown
  Description of Unknown: bacterium polynucleotide
  Actinobacteria; Nocardioidaceae
tacgtagggtgcgagcgttgtccggaattattgggcgtaaagggctcgtaggcggtctgttgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 533 - DNA, 253 bp, Unknown
  Description of Unknown: bacterium polynucleotide
  Actinobacteria; Nocardioidaceae
tacgtagggtgcgagcgttgtccggaattattgggcgtaaagggctcgtaggcggtttgtcgcgtcgggagtgaaaaccaggtgcttaacacttggcttgctttcgatacgggcagactggaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 534 - DNA, 253 bp, Unknown
  Description of Unknown: bacterium polynucleotide
  Actinobacteria; Nocardioidaceae
tacgtagggtgcgagcgttgtccggaattattgggcgtaaagggctcgtaggcggtttgtcgcgtcgggagtgaaaacgccgtgcttaacacggcgcttgctttcgatacgggcagactagaggtattcaggggagaacggaattcctggtgtagcggtgaaatgcgcagatatcaggaggaacaccggtggcgaaggcggttctctgggaatgacctgacgctgaggagcgaaagtgtggggagcgaacagg

SEQ ID NO: 535 - DNA, 252 bp, Unknown
  Description of Unknown: bacterium polynucleotide
  Actinobacteria; Nocardioidaceae
tacgtagggtgcgagcgttgtccggaattttgggcgtaaagggctcgtaggcggtttgtcgcgtcgggagtgaaaacacggggcttaactctgtgcttgcttccgatacgggcagactagagggatgcaggggagaacggaattcctggtgtagcggtggaatgcgcagatatcaggaggaacaccggtggcgaaggcggttctctgggcatttcctgacgctgaggagcgaaagtgtggggagcgaacagg

SEQ ID NO: 536 - DNA, 253 bp, Unknown
  Description of Unknown: bacterium polynucleotide
  Actinobacteria; Nocardioidaceae
tacgtagggtgcgagcgttgtccggaattattgggcgtaaagggctcgtaggcggtttgtcgcgtcgggagtgaaaacacacagcttaactgtgtgcttgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 537 - DNA, 253 bp, Unknown
  Description of Unknown: bacterium polynucleotide
  Actinobacteria; Nocardioidaceae
tacgtagggtgcaagcgttgtccggaattattgggcgtaaagggctcgtaggcggtccatcgcgtcgggagtgaaaagctggggcttaaccccagtcctgctttcgatacgggtggactagaggtaggcaggggagaacggaattcctggtgtagcggtgaaatgcgcaggtatcaggaagaacaccggtggcgaaggcggttctctgggccttacctgacgctgaggagcgaaagcgtggggagcaaacagg

SEQ ID NO: 538 - DNA, 253 bp, Unknown
  Description of Unknown: bacterium polynucleotide
  Actinobacteria; Nocardioidaceae
tacgtagggtccgagcgttgtccggaattattgggcgtaaagggctcgtaggcggtttgtcgcgtcgggagtgaaaacctcatgcttaacatgtggcttgcttccgatacgggcagactagaggtatgcaggggagaatggaattcctggtgtagcggtgaaatgcgcagatatcaggaggaacaccggtggcgaaggcggttctctgggcattacctgacgctgaggagcgaaagtgtggggagcgaacagg

SEQ ID NO: 539 - DNA, 253 bp, Unknown
  Description of Unknown: bacterium polynucleotide
  Actinobacteria; Nocardioidaceae
tacgtagggtccgagcgttgtccggaattattgggcgtaaagggctcgtaggcggtctgttgcgtcgggagtgaaaacttacagcttaactgtgagcgtgcttccgatacgggcagacttgaggtattcaggggagaacggaattcctggtgtagcggtgaaatgcgcagatatcaggaggaacaccggtggcgaaggcggttctctgggaatatcctgacgctgaggagcgaaagtgtggggagcgaacagg

SEQ ID NO: 540 - DNA, 253 bp, Unknown
  Description of Unknown: bacterium polynucleotide
  Actinobacteria; Nocardioidaceae
tacgtagggtgcgagcgttatccggaattattgggcgtaaagggctcgtaggcggtttgtcgcgtcgggagtgagaacaccgggcttaactcggtgcttgctttcgatacgggcagactagaggcatgcaggggagaacggaattcctggtgtagcggtgaaatgcgcagatatcaggaggaacaccggtggcgaaggcggttctctgggcatgtcctgacgctgaggagcgaaagtgtggggagcgaacagg

SEQ ID NO: 541 - DNA, 253 bp, Unknown
  Description of Unknown: bacterium polynucleotide
  Actinobacteria; Nocardioidaceae
tacgtagggtgcgaacgttgtccggagttattgggcgtaaagggctcgtaggcggtttgtcgcgtcgggagtgaaaacatccagcttaactgggtgcttgctttcgatacgggcagacttggggtatgcaggggagaatggaattcctggtgtagcggtgaaatgcgcagatatcaggaggaacaccggtggcgaaggcggttctctgggcattacctgacgctgaggagcgaaagtgtggggagcgaacagg

SEQ ID NO: 542 - DNA, 253 bp, Aeromicrobium sp.
  Actinobacteria; Nocardioidaceae; Aeromicrobium
tacgtagggtccgagcgttgtccggaattattgggcgtaaagggctcgtaggcggtttgtcacgtcgggcgtgaaaactcagggctcaaccctgagcgtgcgttcgatacgggcagactagaggtatgcaggggagaacggaattcctggtgtagcggtggaatgcgcagatatcaggaagaacaccggtggcgaaggcggctctctgggccttacctgacgctgaggagcgaaagcatgggtagcgaacagg

SEQ ID NO: 543 - DNA, 253 bp, Kribbella sp.
  Actinobacteria; Nocardioidaceae; Kribbella
tacgtagggtgcaagcgttgtccggaattattgggcgtaaagggctcgtaggcggttcgtcacgtcgggagtgaaaactcggagctcaactccgagccggcttccgatacgggcagactagaggtaggcaggggagagtggaactcctggtgtagcggtggaatgcgcagatatcaggaagaacaccagtggcgaaggcggctctctgggccttacctgacgctgaggagcgaaagcgtgggtagcgaacagg

SEQ ID NO: 544 - DNA, 253 bp, Kribbella sp.
  Actinobacteria; Nocardioidaceae; Kribbella
tacgtagggtccgagcgttgtccggaattattgggcgtaaagggctcgtaggcggttcgtcacgtcgggagtgaaaactcggggcttaaccccgagcctgcttccgatacgggcagactagaggtaggcaggggagagcggaactcctggtgtagcggtggaatgcgcagatatcaggaagaacaccggtggcgaaggcggctctctgggccttacctgacgctgaggagcgaaagcgtgggtagcgaacagg

SEQ ID NO: 545 - DNA, 253 bp, Kribbella sp.
  Actinobacteria; Nocardioidaceae; Kribbella
tacgtagggtgcgagcgttgtccggaattattgggcgtaaagggctcgtaggcggttcgtcacgtcgggagtgaaaactcggggcttaaccccaagcttgcggtcgatacgggcagacttgagttcggcaggggagagcggaactcctggtgtagcggtggaatgcgcagatatcaggaagaacgccggtggcgaaggcggctctctgggccttacctgacgctgaggtgcgaaagtgtggggagcgaacagg

SEQ ID NO: 546 - DNA, 253 bp, Nocardioides lentus
  Actinobacteria; Nocardioidaceae; Nocardioides lentus
tacgtagggggcgagcgttgtccggaatcattgggcgtaaagagcgtgtaggcggcttggcaagtctgacgtgaaagcccgcggctcaacctcggattgtcgttgggaactgcctcgctagagtccggaagaggagagcggaattcctggtgcagcggtggaatgcgcagatatcaggaggaacaccggtggcgaaggcggttctctgggcattacctgacgctgaggagcgaaagtgtggggagcgaacagg

SEQ ID NO: 547 - DNA, 253 bp, Nocardioides sp.
  Actinobacteria; Nocardioidaceae; Nocardioides
tacgtagggtgcgagcgttgtccggaattattgggcgtaaagggctcgtaggcggtttgtcgcgtcgggagtgaaaacctcgggcttaactcggggcttgctttcgatacgggcagactagaggtatgcaggggagaacggaattcctggtgtagcggtgaaatgcgcagatatcaggaggaacaccggtggcgaaggcggttctctgggcatgatctgacgctgaggagcgaaagtgtggggagcgaacagg

SEQ ID NO: 548 - DNA, 253 bp, Nocardioides plantarum
  Actinobacteria; Nocardioidaceae; Nocardioides plantarum
tacgtagggtgcgagcgttgtccggaattattgggcgtaaagggctcgtaggcggtttgttgcgtcgggagtgaaaacactgggcttaaccgagtgcttgctttcgatacgggcagacttgaggcattgaggggagaacggaattcctggtgtagcggtgaaatgcgcagatatcaggaggaacaccggtggcgaaggcggttctctggcaatgttctgacgctgaggagcgaaagtgtggggagcgaacagg

SEQ ID NO: 549 - DNA, 253 bp, Nocardioides sp.
  Actinobacteria; Nocardioidaceae; Nocardioides
gacggggagggcgagtgttattcagcgtaattgggcgtaaagggctcgtaggcggtttgtcgcgtcgggagtgaaaacaccgggcttaactcggtgcttgctttcgatacgggcagactggaggtatgcaggggagaacggaattcctggtgtagcggtgaaatgcgcagatatcaggaggaacaccggtggcgaaggcggcttactggtccattactgacgctgaggtgcgaaagcgtggggagcaaacagg

SEQ ID NO: 550 - DNA, 253 bp, Nocardioides dilutus
  Actinobacteria; Nocardioidaceae; Nocardioides dilutus
tacgtagggtccgagcgttgtccggaattattgggcgtaaagggctcgtaggcggtttgtcgcgtcgggagtgaaatcttacagcttaactgtgaacttgctttcgatacgggcagacttgaggcattcaggggagaacggaattcctggtgtagcggtgaaatgcgcagatatcaggaggaacaccggtggcgaaggcggttctctgggaatgttctgacgctgaggagcgaaagtgtggggagcgaacagg

SEQ ID NO: 551 - DNA, 253 bp, Nocardioides fonticola
  Actinobacteria; Nocardioidaceae; Nocardioides fonticola
tacgtagggtgcgagcgttgtccggaattattgggcgtaaagggctcgtaggcggtttgtcgcgtcgggagtgaaatccatcagcttaactgatggcttgctttcgatacgggcagactagaggcattcaggggagaacggaattccgggtgtagcggtgaaatgcgcagatatcaggaggaacaccggtggcgagggcgactttctggtctgtaactgacgctgaggcgcgaaagcgtggggagcaaacagg

SEQ ID NO: 552 - DNA, 253 bp, Nocardioides sp.
  Actinobacteria; Nocardioidaceae; Nocardioides
tacgtagggtccgagcgttgtccggaattattgggcgtaaagggctcgtaggcggtctgtcgcgtcgggagtgaaaaccaggtgcttaacacctggcctgctttcgatacgggcagtcttgaggcatgcaggggagaacggaattcctggtgtagcggtgaaatgcgcagatatcaggaggaacaccggtggcgaaggcggttctctgggcatgttctgacgctgaggagcgaaagtgtggggagcgaacagg

SEQ ID NO: 553 - DNA, 253 bp, Pimelobacter sp.
  Actinobacteria; Nocardioidaceae; Pimelobacter
tacgtagggtccgagcgttgtccggaattattgggcgtaaagggctcgtaggcggtttgtcgcgtcgggagtgaaaacagcgggcttaactcgttgcttgcttccgatacgggcagactagaggtatgcaggggagaatggaattcctggtgtagcggtgaaatgcgcagatatcaggaggaacaccggtggcgaaggcggttctctgggcattacctgacgctgaggagcgaaagcgtggggagcgaacagg

SEQ ID NO: 554 - DNA, 253 bp, Unknown
  Description of Unknown: bacterium polynucleotide
  Actinobacteria; Nocardiopsaceae
tacgtagggtccgagcgttgtccggaattattgggcgtaaagagctcgtaggcggtatgtcgcgtctgctgtgaaagaccggggcttaacttcggttttgcagtggatacgggcatgctggaggtaggtaggggagactggaattcctggtgtagcggtgaaatgcgcagatatcaggaggaacaccggtggcgaaggcgggtctctgggccttacctaacgctgaggagcgaaagcatgggtagccaacagg

SEQ ID NO: 555 - DNA, 253 bp, Nocardiopsis exhalans
  Actinobacteria; Nocardiopsaceae; Nocardiopsis exhalans
tacgtagggtccgagcgttgtccggaattattgggcgtaaagagctcgtaggcggcatgtcgcgtctgctgtgaaagatcggggcttaactccggttctgcagtggatacgggcatgctagaggtaggtaggggaaactggaattcctggtgtagcggtgaaatgcgcagatatcaggaggaacaccggtggcgaaggcgggtttctgggccttacctgacgctgaggagcgaaagcatggggagcgaacagg

SEQ ID NO: 556 - DNA, 253 bp, Cellulosimicrobium sp.
  Actinobacteria; Promicromonosporaceae; Cellulosimicrobium
tacgtagggcgcaagcgttgtccggaattattgggcgtaaagagctcgtaggcggtttgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacagg

SEQ ID NO: 557 - DNA, 253 bp, Promicromonospora sp.
  Actinobacteria; Promicromonosporaceae; Promicromonospora
tacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacagg

SEQ ID NO: 558 - DNA, 253 bp, Unknown
  Description of Unknown: bacterium polynucleotide
  Actinobacteria; Pseudonocardiaceae
tacgtagggtgcgagcgttgtccggagttactgggcgtaaagagctcgtaggcggtgtgtcgcgtcggccgtgaaatcctgctgcttaacggtgggcttgcggtcgatacgggcagactagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 559 - DNA, 253 bp, Unknown
  Description of Unknown: bacterium polynucleotide
  Actinobacteria; Pseudonocardiaceae
tacgtagggtgcgagcgttgtccggaattattgggcgtaaagagctcgtaggcggtttgtcgcgtcgactgtgaaaactgggggcttaactctcagcttgcagtcgatacgggcagacttgggttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 560 - DNA, 254 bp, Actinomycetospora sp.
  Actinobacteria; Pseudonocardiaceae; Actinomycetospora
tacgtagggtgcgagcgttgtccggaattattgggcgtaaagagctcgtaggcggtgtgtcacgtcggccgtgaaaacctggggctcaactctgggcgtgcggtcggtacgggcatcacttgagttcggcaggggagactggaattcctggtgtagcggtgaaatgcgcagatatcaggaggaacaccggtggcgaaggcgggtctctgggccgatactgacgctgaggagcgaaagcatgggtagcgaacagg

SEQ ID NO: 561 - DNA, 253 bp, Amycolatopsis sp.
  Actinobacteria; Pseudonocardiaceae; Amycolatopsis
tacgtagggtgcgagcgttgtccggatttattgggcgtaaagagctcgtaggcggtttgccgcgtcggccgtgaaatctccacgcttaacgtggagcgtgcggtcgatacgggcagacttgagttcggtaggggagactggaattcctggtgtagcggtgaaatgcgcagatatcaggaggaacaccggtggcgaaggcgggtctctgggccgatactgacgctgaggtgcgaaagcgtggggagcaaacagg

SEQ ID NO: 562 - DNA, 253 bp, Amycolatopsis sp.
  Actinobacteria; Pseudonocardiaceae; Amycolatopsis
tacgtagggtgcgagcgttgtccggaattattgggcgtaaagagctcgtaggcggtttgtcgcgtcgttcgtgaaaactccacgcttaacgtggagcgtgcgggcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 563 - DNA, 254 bp, Pseudonocardia sp.
  Actinobacteria; Pseudonocardiaceae; Pseudonocardia
tacgtagggtgcgagcgttgtccggaattattgggcgtaaagagctcgtaggcggtgtgtcacgtcgatcgtgaaaacttggggcttaaccctgagcgtgcggtcgatacgggcatcactagagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 564 - DNA, 254 bp, Pseudonocardia sp.
  Actinobacteria; Pseudonocardiaceae; Pseudonocardia
cacgtagggtgcgagcgttgtccggaattattgggcgtaaagagctcgtaggcggtgtgtcgcgtcggccgtgaaaacctgcagctcaactgtgggcttgcggtcgatacgggcatcactggagttcggcaggggagactggaattcctggtgtagcggtgaaatgcgcagatatcaggaggaacaccggtggcgaaggcgggtctctgggccgatactgacgctgaggagcgaaagcgtggggagcaaacagg

SEQ ID NO: 565 - DNA, 254 bp, Pseudonocardia sp.
  Actinobacteria; Pseudonocardiaceae; Pseudonocardia
cacgtagggtgcgagcgttgtccggaattattgggcgtaaagagctcgtaggcggtgtgtcacgtcggccgtgaaaacttacagcttaactgtgagcgtgcggtcgatacgggcatcacttgagttcggcaggggagactgggattcctggtgtagcggtgaaatgcgcagatatcaggaggaacaccggtggcgaaggcgggtctctgggccgatactgacgctgaggagcgaaagcgtggggagcgaacagg

SEQ ID NO: 566 - DNA, 253 bp, Saccharopolyspora sp.
  Actinobacteria; Pseudonocardiaceae; Saccharopolyspora
tacgtagggtgcgagcgttgtccggatttattgggcgtaaagagctcgtaggcggtttgtcgcgtcggccgtgaaaacctgccgcttaacggtgggcgtgcggtcgatacgggcagacttgagttcggtagggcagactggaattcctggtgtagcggtgaaatgcgcagatatcaggagtaacaccggtggcgaaggcgggtctctgggccgatactgacgctgaggagcgaaagcgtggggagcgaacagg

SEQ ID NO: 567 - DNA, 253 bp, Unknown
  Description of Unknown: bacterium polynucleotide
  Actinobacteria; Sporichthyaceae
tacgtagggtgcaagcgttgtccggaattattgggcgtaaagagctcgtaggcggtctgtcgcgtcggctgtgaaaacttggggctcaaccccaagcctgcagtcgatacgggcagactagagtgcggtaggggagactggaattcctggtgtagcggtgaaatgcgcagatatcaggaggaacaccggtggcgaaggcgggtctctgggccgtaactgacgctgaggagcgaaagcgtggggagcaaacagg

SEQ ID NO: 568 - DNA, 253 bp, Unknown
  Description of Unknown: bacterium polynucleotide
  Actinobacteria; Sporichthyaceae
tacgtagggtgcaagcgttgtccagaattattgggcgtaaagagctcgtaggcggtctgtcgcgtcggctgtgaaaactcggggctcaaccccgagcccgcagtcgatacgggcagactagagtgctgtaggggagactggaattcctggtgtagcggtgaaatgcgcagatatcaggaggaacatcggtggcgaaggcgggtctctgggcagtaactgacgctgaggagcgaaagcgtggggagcgaacagg

SEQ ID NO: 569 - DNA, 253 bp, Sporichthya sp.
  Actinobacteria; Sporichthyaceae; Sporichthya
tacgtagggtgcaagcgttgtccggaattattgggcgtaaagagctcgtaggcggcttgtcacgtctgctgtgaaaactcggggctcaaccccgagcctgcagtggatacgggctagctagagtgcggtaggggagaccggaattcctggtgtagcggtgaaatgcgcagatatcaggaggaacaccggtggcgaaggcgggtctctggaccgatactgacgctgaggagcgaaagcgtggggagcgaacagg

SEQ ID NO: 570 - DNA, 253 bp, Unknown
  Description of Unknown: bacterium polynucleotide
  Actinobacteria; Streptomycetaceae
tacgtagggtgcgagcgttgtccggaattattgggcgtaaagagctcgtaggcggcttgtcacgtcggatgtgaaagcccggggcttaaccccgggtctgcattcgatacgggcaggctagagtgtggtaggggagatcagaattcctggtgtagcggtgaaatgcgcaaatatcaggaggaacaccggtggcgaaggcggatctctgggccattactgacgctgaggagcgaaagcgtggggagcgaacagg

SEQ ID NO: 571 - DNA, 254 bp, Streptomyces sp.
  Actinobacteria; Streptomycetaceae; Streptomyces
tacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagacgaaagctaggggagcgaatggg

SEQ ID NO: 572 - DNA, 253 bp, Streptomyces sp.
  Actinobacteria; Streptomycetaceae; Streptomyces
tacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 573 - DNA, 253 bp, Streptomyces mirabilis
  Actinobacteria; Streptomycetaceae; Streptomyces mirabilis
tacagaggatgcaagcgttgtccggaattattgggcgtaaagagctcgtaggcggcttgtcacgtcgggtgtgaaagcccggggcttaaccccgggtctgcattcgatacgggctagctagagtgtggtaggggagatcggagttcctggtgtagcggtgaaatgcgcagatatcaggaggaacaccggtggcgaaggcggatctctgggccatgactgacgctgaggagcgaaagcgtggggagcgaacagg

SEQ ID NO: 574 - DNA, 253 bp, Streptomyces mirabilis
  Actinobacteria; Streptomycetaceae; Streptomyces mirabilis
tacgtaggtggcaagcgttatccggaattattgggcgtaaagagctcgtaggcggctagtcacgtcgggtgtgaaagaccggggcttaaccccggttctgcattcgatacgggctggctagagtgtggtaggggagatcggaattcctggtgtagcggtgaaatgcgcagatatcaggatgaacaccggtggcgaaggcggatctctgggccattactgacgctgaggagcgaaagcgtggggagcgaacagg

SEQ ID NO: 575 - DNA, 253 bp, Streptomyces mirabilis
  Actinobacteria; Streptomycetaceae; Streptomyces mirabilis
tacgtagggcgcaagcgttgtccggaattattgggcgtaaagagctcataggcggcttgtcacgtcgggtgtgaaagcccggggcttaaccccgggcctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 576 - DNA, 253 bp, Streptomyces sp.
  Actinobacteria; Streptomycetaceae; Streptomyces
tacgtagggtgcaagcgttgtccggaattattgggcgtaaagagctcgtaggcggcctgtcgcgtcggatgtgaaagcccggggcttaaccctgggtctgcattcgatacgggcaggctagagttcggtaggggagatcggaattcctggtgtagcggtgaaatgcgcagatatcaggaggaacaccggtggcgaaggcggatctctaggccgatactgacgctgaggagcgaaagcatggggagcgaacagg

SEQ ID NO: 577 - DNA, 253 bp, Streptomyces sp.
  Actinobacteria; Streptomycetaceae; Streptomyces
tacgtagggtgcaagcgttatccggaattattgggcgtaaagagctcgtaggcggcttgtcgcgtcggatgtgaaagcccggggcttaactccgggtctgcattcgatacgggcaggctagagttcggtaggggagatcggaattcctggcgtagcggtgaaatgcgcagatatcaggaggaacaccggtggcgaaggcggatctctgggccgatactgacgctgaggagcgaaagcgtggggagcaaacagg

SEQ ID NO: 578 - DNA, 253 bp, Streptomyces mirabilis
  Actinobacteria; Streptomycetaceae; Streptomyces mirabilis
tacgtagagcgcaagcgttgtccggaattattgggcgtaaagagctcgtaggcggcttgtcacgtcgggtgtgaaagcccaggacttaaccccgggtctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtaggaagcgaacagg

SEQ ID NO: 579 - DNA, 253 bp, Streptomyces radiopugnans
  Actinobacteria; Streptomycetaceae; Streptomyces radiopugnans
tacggagggggctagcgttgtccggaattattgggcgtaaagagctcgtaggcggcttgtcgcgtcggatgtgaaagcccggggcttaactccgggtctgcattcgatacgggcaggctagagttcggtaggggagatcggaattcctggtgtagcggtgaaatgcgcagatatcaggaggaacaccggtggcgaaggcggatctctgggccgatactgacgctgagacacgaaagccaggggagcgaacagg

SEQ ID NO: 580 - DNA, 254 bp, Streptomyces sp.
  Actinobacteria; Streptomycetaceae; Streptomyces
tacgtagggtgcgagcgttgtccggaattattgggcgtaaagagctcgtaggcggcttgtcgcgtcggatgtgaaagcccggggcttaactccgggtctgcattcgatacgggcaggctagagttcggtggggggagatcggaattcctggtgtagcggtgaagtgcgcagatatcaggaggaacaccggtggcgaaggcggatctctgggccgacactgacgctgaggagcgaaagcgtggggagcgaacagg

SEQ ID NO: 581 - DNA, 253 bp, Nonomuraea sp.
  Actinobacteria; Streptosporangiaceae; Nonomuraea
tacgtagggcgcaagcgttgtccggaattattgggcgtaaagagctcgtaggtggctggtcgcgtctgccgtgaaagcccgcagcttaactgcgggtctgcggtggatacgggtcggctagaggtaggtaggggcaagtggaattcctggtgtagcggtgaaatgcgcagatatcaggaggaacaccggtggcgaaggcggcttgctgggccttacctgacgctgaggagcgaaagcgtggggagcgaacagg

SEQ ID NO: 582 - DNA, 253 bp, Sphaerisporangium sp.
  Actinobacteria; Streptosporangiaceae; Sphaerisporangium
tacgtagggcgcaagcgttgtccggaattattgggcgtaaagagctcgtaggtggcttgtcgcgtctgccgtgaaagcccatggcttaactgtgggtctgcggtggatacgggctggctagaggtaggtaggggcaagcggaattcctggtgtagcggtgaaatgcgcagatatcaggaggaacaccggtggcgaaggcggcttgctgggccttacctgacgctgaggagcgaaagcgtggggagcgaacagg

SEQ ID NO: 583 - DNA, 253 bp, Streptosporangium sp.
  Actinobacteria; Streptosporangiaceae; Streptosporangium
tacgtagggtgcaagcgttgtccggaattattgggcgtaaagagctcgtaggtggcttgtcacgtcgggtgtgaaagcttggggcttaactccaggtctgcattcgatacgggctggctagaggtaggtaggggagaacggaattcctggtgtagcggtgaaatgcgcagatatcaggaggaacaccggtggcgaaggcggttctctgggccttacctgacgctgaggagcgaaagcgtggggagcgaacagg

SEQ ID NO: 584 - DNA, 253 bp, Unknown
  Description of Unknown: bacterium polynucleotide
  Actinobacteria; Thermomonosporaceae
tacgtagggcgcgagcgttgtccggaattatcgggcgtaaagagctcgtaggcggccggttgcgtctgctgtgaaatcccggggcttaaccccgggcgtgcagtggatacgggccggctggaggcaggcaggggagaatggaattcccggtgtagcggtgaaatgcgcagatatcgggaggaacaccggtggcgaaggcggttctctgggcctgtactgacgcagaggagcgaaagcgtggggagcaaacagg

SEQ ID NO: 585 - DNA, 254 bp, Actinoallomurus sp.
  Actinobacteria; Thermomonosporaceae; Actinoallomurus
tacgtagggcgcaagcgttgtccggaattattgggcgtaaagggctcgtaggcggtttgtcgcgtctgccgtgaaaacccgaggcttaacctcgtggcttgcggtggatacgggcaaactagaggtaggtaggggagaatggaattcccggtgtagcggtgaaatgcgcagatatcggggggaacaccggtggcgaaggcggttctctgggccttacctgacgctgaggagcgaaagcgtggggagcgaacagg

SEQ ID NO: 586 - DNA, 253 bp, Actinoallomurus sp.
  Actinobacteria; Thermomonosporaceae; Actinoallomurus
cacgtagggcgcaagcgttgtccggaattattgggcgtaaagagctcgtaggtggtctgctgcgtccgctgtgaaaatccagggcttaaccttgggcttgcagtggatacgggcagactagaggtaggtaggggagaatggaattcccggtgtagcggtgaaatgcgcagatatcgggaggaacaccggtggcgaaggcggttctctgggccttacctgacactgaggagcgaaagcgtggggagcgaacagg

SEQ ID NO: 587 - DNA, 253 bp, Actinoallomurus sp.
  Actinobacteria; Thermomonosporaceae; Actinoallomurus
tacagagactgcaagcgttgtccggaattattgggcgtaaagagctcgtaggcggattgtcgcgtctgctgtgaaaagctggggcttaaccctggccttgcagtggatacgggcagactagaggtaggtaggggagaatggaattcccggtgtagcggtgaaatgcgcagatatcgggaggaacaccggtggcgaaggcggttctctgggccttacctgacgctgaggagcgaaagcgtggggagcgaacagg

SEQ ID NO: 588 - DNA, 253 bp, Actinomadura vinacea
  Actinobacteria; Thermomonosporaceae; Actinomadura vinacea
tacgtagggcgcaagcgttgtccggaattattgggcgtaaagagctcgtaggcggtttgtcgcgtctgtcgtgaaagcccacggcttaactgtgggtctgcggtggatacgggcagactagaggcaggtaggggagaatggaattcccggtgtagcggtgaaatgcgcagatatcgggaggaacaccggtggcgaaggcggttctctgggcctgtactgacgctgaggagcgaaagcgtggggagcgaacagg

SEQ ID NO: 589 - DNA, 253 bp, Actinomadura vinacea
  Actinobacteria; Thermomonosporaceae; Actinomadura vinacea
tacgtagggcgcaagcgttgtccggaattattgggcgtaaagagctcgtaggcggtttgtcgcgtctgccgtgaaagcccggggcttaactccgggtctgcggtggatacgggcagactagaggcaggtaggggagaacggaattcccggagtagcggtgaaatgcgcagatatcgggaggaacaccggtggcgaaggcggttctctgggcctgttctgacgctgaggagcgaaagcgtggggagcgaacagg

SEQ ID NO: 590 - DNA, 253 bp, Actinomadura vinacea
  Actinobacteria; Thermomonosporaceae; Actinomadura vinacea
aacgtagggcgcaagcgttgtccggatttattgggcgtaaagagctcgtaggtggtttgtcgcgtctgtcgtgaaagcccgtggcttaactgtgggtttgcggtggatacgggcagactagaggcaggtaggggagagtggaattcccggtgtagcggtgaaatgcgcagatatcgggaggaacaccggtggcgaaggcggctctctgggcctgtcctgacgctgaggagcgaaagcgtgggtagcgaacagg

SEQ ID NO: 591 - DNA, 253 bp, Tsukamurella sp.
  Actinobacteria; Tsukamurellaceae; Tsukamurella
tacgtagggtgcaagcgttgtccggaattactgggcgtaaagagctcgtaggcggtttgtcacgtcgtctgtgaaaacccgaggcttaacctcgggcctgcaggcgatacgggcagacttgagtactgtaggggagactggaattcctggtgtagcggtggaatgcgcagatatcaggaggaacaccggtggcgaaggcgggtctctgggcagtaactgacgctgaggagcgaaagcgtgggtagcgaacagg

SEQ ID NO: 592 - DNA, 253 bp, Williamsia sp.
  Actinobacteria; Williamsiaceae; Williamsia
tacgtagggtgcgagcgttgtccggaattactgggcgtaaagagctcgtaggcggtttgtcgcgtcgttcgtgaaatcttgatgcttaacatcaagcgtgcgggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacagg

SEQ ID NO: 593 - DNA, 253 bp, Unknown
  Description of Unknown: bacterium polynucleotide
  Alphaproteobacteria
tacgaagggggctagcgttgttcggatttactgggcgtaaagcgcacgtaggcggacttttaagtcaggggtgaaatcccggggctcaaccccggaactgcctttgatactggaagtcttgagttcgagagaggtgagtggaattgcgagtgtagaggtgaaattcgtagatattcgcaggaacaccagtggcgaaggcggctcactggctcgatactgacgctgaggtgcgaaagcgtggggagcaaacagg

SEQ ID NO: 594 - DNA, 253 bp, Unknown
  Description of Unknown: bacterium polynucleotide
  Alphaproteobacteria
gacggagggtgctagcgttgttcggaatgactgggcgtaaagggcgcgtaggcggttttatcagtcaggcgtgaaagccccgggcttaacctgggaactgcgtttgatactgtagaacttgagaatggaagaggaaagcggaattcctagtgtagaggtgaaattcgtagatattaggaggaacaccagaggcgaaggcggctttctggtccattactgacgctgaggcgcgaaagcgtggggagcaaacagg

SEQ ID NO: 595 - DNA, 253 bp, Unknown
  Description of Unknown: bacterium polynucleotide
  Alphaproteobacteria
tacgaagggggctagcgttgttcggaattactgggcgtaaagcgcgcgcaggcggtcttccaagtcagtggtgaaagcccggagctcaactccggaactgccattgaaactgttggacttgagtatgagagaggtgagtggaattcccagtgtagaggtgaaattcgtagatattgggaagaacaccggtggcgaaggcggctcactggctcattactgacgctcaggcgcgacagcgtggggatcaaacagg

SEQ ID NO: 596 - DNA, 253 bp, Unknown
  Description of Unknown: bacterium polynucleotide
  Alphaproteobacteria
tacgaagggggctagcgttgttcggaattactgggcgtaaagcgcgcgcaggcggctatccaagtcagtggtgaaagcccggagctcaactccggaactgccattgaaactgtttagcttgaggacgagagaggtgagtggaattcccagtgtagaggtgaaattcgtagatattgggaagaacaccggtggcgaaggcggctcactggctcgtatctgacgctcaggcgcgacagcgtggggatcaaacagg

SEQ ID NO: 597 - DNA, 253 bp, Unknown
  Description of Unknown: bacterium polynucleotide
  Alphaproteobacteria
tacgaatggggcaagcgttgttcggaatcactgggcttaaagcgtgcgtaggcggacctccaagtcaggagtgaaatcccagggcttaaccctggaattgctcttgaaactggtggtcttgaatcctggaggggttgggagaattcctagtgtagaggtgaaattcgcagatattaggaggaataccagtggcgtaggcgcccaactggacaggtattgacgctgaggtacgaaagcgtgggtagcaaacagg

SEQ ID NO: 598 - DNA, 253 bp, Unknown
  Description of Unknown: bacterium polynucleotide
  Alphaproteobacteria
gacggagggggctagcgttgttcggaatgactgggcgtaaagggcgcgtaggcggttttttaagtgaggcgtgaaagccctgggcttaacctaggaggtgcgtttcatactggaagacttgagtacgagagaggaaagcggaattcctagtgtagaggtgaaattcgtagatattaggaagaacaccagtggcgaaggcggctttctggctcgtaactgacgctgaggcgcgaaagcgtggggagcaaacagg

SEQ ID NO: 599 - DNA, 253 bp, Unknown
  Description of Unknown: bacterium polynucleotide
  Alphaproteobacteria
tacgaagggggcgagcattgttcggaattactgggcgtaaagggtgcgtaggcggattagatagtcaggtgtgaaagcccaaggctcaaccttggaattgcatttgatactgctagtctggagtattggagaggaacgtggaattctcagtgtagaggtgaaattcgtagatattgagaggaacaccagtggcgtaggcgacgttctggccaaatactgacgctgaggcacgaaagtgtggggagcaaacagg

SEQ ID NO: 600 - DNA, 253 bp, Unknown
  Description of Unknown: bacterium polynucleotide
  Alphaproteobacteria
tacgaagggtgctagcgttgttcggaattactgggcgtaaagcgcgcgtaggcggcttgtcaagtcaggggtgaaatcccacagctcaactgtggaattgcctttgaaactgtcaggctagagtgtcggaggggatagcggaattgctaatgtagaggtgaaattcgtagatattagcaggaacaccggtggcgaaggcggctatctggacgacaactgacgctgaggcgcgaaagcgtggggatcaaacagg

SEQ ID NO: 601 - DNA, 253 bp, Unknown
  Description of Unknown: bacterium polynucleotide
  Alphaproteobacteria
gacgaagggggctagcgttgttcggaattactgggcgtaaagcgcgtgtaggcggttttccaagttgggtgtgtaagccttgggcttaacccaagaaatgcactcagtactggaagactagaggaccggagaggatagtggaattcccagtgtagtggtgaaatacgtagagattgggaagaacacctgtggcgaaggcggctatctggacggtttctgacgctaagacgagaaagcgtggggagcaaacagg

SEQ ID NO: 602 - DNA, 253 bp, Unknown
  Description of Unknown: bacterium polynucleotide
  Alphaproteobacteria
gacagagggtgcaaacgttgttcggaattactgggcgtaaagcgcgtgtaggtggttctcatagtcaggggtgaaagcccgcagcttaactgcggaattgcccttgaaactggagagctagagtctgttagaggatagtggaattcctagtgtagcggtgaaatgcgtagatattaggaggaacaccagtggcgaaggcggctatctgggacagtactgacactgagaaacgaaagcttgggtagcaaacggg

SEQ ID NO: 603 - DNA, 253 bp, Unknown
  Description of Unknown: bacterium polynucleotide
  Alphaproteobacteria
tacggagggagcgagcgttgttcggaattactgggcgtaaagcgtgcgcagacggatttccaagtcaggagtgaaatccccgggctcaacccgggaattgctcttgaaactggatgtctggagtctcggagaggttggcggaattcccagtgtagaggtgaaattcgtagatattgggaggaacaccagtggcgtaagcggccaactggacgagtactgacgctcatgcacgaaagtgtggggatcaaacagg

SEQ ID NO: 604 - DNA, 253 bp, Unknown
  Description of Unknown: bacterium polynucleotide
  Alphaproteobacteria
tacgaagggggctagcgttgttcggaattactgggcgtaaagcgcgcgcaggcggtctttcaagtcagtggtgaaagcctggagctcaactccagaactgccattgaaactgcaagacttgagtacgagagaggtgagtggaattcccagtgtagaggtgaaattcgtagatattgggaagaacaccagtggcgaaggcggctcactggctcgtaactgacgctcaggcgcgacagcgtggggatcaaaccgg

SEQ ID NO: 605 - DNA, 253 bp, Unknown
  Description of Unknown: bacterium polynucleotide
  Alphaproteobacteria
tacgaagggggctagcgttgttcggaattactgggcgtaaagcgcacgtaggcgggttgttaagtcaggggtgaaatcctggagctcaactccagaactgcctttgatactggcaacctagagactggaagaggttagtggaattcccagtgtagaggtgaaattcgtagatattgggaagaacaccagtggcgaaggcggctaactggtccagcactgacgctgaggtgcgaaagcgtggggagcaaacagg

SEQ ID NO: 606 - DNA, 253 bp, Unknown
  Description of Unknown: bacterium polynucleotide
  Alphaproteobacteria
tacgaatggggcaagcgttgttcggaatcactgggcttaaagcgtgcgtaggcggatttgcaagtcagaagtgaaatcccagggcttaaccctggaattgcttttgaaactgcaagtctagaatcttgaagaggttagcagaattccgagtgtagaggtgaaattcgcagatattcggaggaataccaatggcgtaggcagctaactgggcaagtattgacgctgaggcacgaaagcgtggggagcaaacagg

SEQ ID NO: 607 - DNA, 253 bp, Unknown
  Description of Unknown: bacterium polynucleotide
  Alphaproteobacteria
tacgaagggggctagcgttgttcggaattactgggcgtaaggcgcgcgtaggcggtcttccaagtcagtggtgaaagcccggagctcaactccggaattgccattgaaactgtaagacttgaggatgagggaggtgagtggaattcccagtgtagaggtgaaattcgtagatattgggatgaacaccggtggcgaaggcggctcactggctcatttctgacgctcaggcgcgacagcgtggggatcaaacagg

SEQ ID NO: 608 - DNA, 254 bp, Unknown
  Description of Unknown: bacterium polynucleotide
  Alphaproteobacteria
tacgaagggggctagcgttgctcggaatcactgggcgtaaagcgcacgtaggtgggtcgttaagtcgggggtgaaatcccagagctcaactctggaactgccttcgatactggcgaccttcgagttcgggagaggtgagtggaactgcgagtgtagaggtgaaattcgtagatattcgcaagaacaccagtggcgaaggcggctcactggcccgatactgacactgaggtgcgaaagcgtggggagcaaacagg

SEQ ID NO: 609 - DNA, 253 bp, Unknown
  Description of Unknown: bacterium polynucleotide
  Alphaproteobacteria
tacggagggagctagcgttgttcggaattactgggcgtagagcgcacgtaggcggcaattcaagtcagaggtgaaagcccggggctcaaccccggaactgcccttaaaactagattgctagaatcctggagaggttagtggaattccgagtgtagaggtgaaattcgtagatattcggaagaacaccagtggcgaaggcgactaactggacaggtattgacgctgaggtgcgaaagcgtggggagcaaacagg

SEQ ID NO: 610 - DNA, 253 bp, Unknown
  Description of Unknown: bacterium polynucleotide
  Alphaproteobacteria
tacgaagggggcgagcgttgttcggaattactgggcttaaagcgtgcgtaggcggattgaaaagtcagaagtgaaatcccggggcttaaccccggaactgcttttgaaactctcagtcttgaattcggaagaggttggcggaatacccagtgtagaggtgaaattcgcagatattgggtagaacaccggtggcgaaggcggccaactggtccgacattgacgctgaggcacgaaagcgtggggagcaaacagg

SEQ ID NO: 611 - DNA, 253 bp, Unknown
  Description of Unknown: bacterium polynucleotide
  Alphaproteobacteria
tacgtagggtgcaagcgttaatcggaattactgggtgtaaagggcgtgtaggcggtaccataagtcagatgtgaaagccctaggcttaacctaggaggtgcatttgatactgtggaactagagatcgagagaggaaagtggaattacgagtgtagaggtgaaattcgtagatattcgtaagaacaccagtggcgaaggcgactttctggctcgatactgacgctaaggcgcgaaagcgtggggagcaaacagg

SEQ ID NO: 612 - DNA, 253 bp, Unknown
  Description of Unknown: bacterium polynucleotide
  Alphaproteobacteria
tacggagggagcgagcgttgttcggaattactgggcgtaaagggtgcgcaggcggctttgcaagtcgggagtgaaatcccagggcttaaccctggaattgctttcgaaactgcagagctcgagtctcggagaggttggcggaattcccagtgtagaggtgaaattcgtagatattgggaggaacaccagtggcgtaagcggccaactagacgagtactgacgctcaagcacgaaagcgtggggatcaaacagg

SEQ ID NO: 613 - DNA, 253 bp, Unknown
  Description of Unknown: bacterium polynucleotide
  Alphaproteobacteria
tacgaagggggctagcgttgttcggaattactgggcgtaaagcgcgcgcaggtggttttccaagtcagtggtgaaagcccggagctcaactccggaactgccattgaaactgtgaaactcgaggacgagagaggtgagtggaattcccagtgtagaggtgaaattcgtagatattgggaagaacaccggtggcgaaggcggctcactggctcgtatctgacactcaagcgcgacagcgtggggatcaaacagg

SEQ ID NO: 614 - DNA, 253 bp, Unknown
  Description of Unknown: bacterium polynucleotide
  Alphaproteobacteria
tacgaagggggctagcgttgctcggaatcactgggcgtaaagcgcacgtaggcgggttgttaagtcgggggtgaaatcctggagctcaactccagaactgccttcgatactggcgacctagagtccgggagaggtgagtggaactccgagtgtagaggtgaaattcgtagatattcggaagaacaccaatggcgaaggcggctcactggcccggtactgacgctgaggtgcgaaagcgtggggagcaaacagg

SEQ ID NO: 615 - DNA, 253 bp, Unknown
  Description of Unknown: bacterium polynucleotide
  Alphaproteobacteria
tacgaagggggctagcgttgttcggaattactgggcgtaaagcgcacgtaggcgggttattaagtcaggggtgaaatcccggagctcaactccggaactgcctttgatactggtaatctagagatcggaagaggttagtggaattcccagtgtagaggtgaaattcgtagatattgggaagaacaccagtggcgaaggcggctaactggtccgatactgacgctgaggtgcgaaagcgtggggagcaaacagg

SEQ ID NO: 616 - DNA, 253 bp, Unknown
  Description of Unknown: bacterium polynucleotide
  Alphaproteobacteria
tacgaagggggcgagcgttgttcggaattactgggcttaaagcgtgcgtaggcggatatacaagtcagaagtgaaatcccagggcttaaccttggaattgcttttgaaactgtatgtctagaatccggtagaggttaatggaatatccagtgtagaggtgaaattcgcagatattggatggaacaccagtggcgaaggcgattaactgggccggtattgacgctgaggtacgaaagcgtggggagcaaacagg

SEQ ID NO: 617 - DNA, 253 bp, Unknown
  Description of Unknown: bacterium polynucleotide
  Alphaproteobacteria
tacgaagggggctagcgttgttcggaattactgggcgtaaagcgtgcgcaggcggcttctcaagtcaggggtgaaagcccagagctcaactctggaactgcctttgagactgagaggctcgagtaggggagaggtgagtggaattcccagtgtagaggtgaaattcgtagatattgggaagaacaccggtggcgaaggcggctcactggcccgcaactgacgctcatacacgacagcgtggggatcaaacagg

SEQ ID NO: 618 - DNA, 253 bp, Unknown
  Description of Unknown: bacterium polynucleotide
  Alphaproteobacteria
tacgaagggggctagcgttgttcggaattactgggcgtaaagcgcgcgtaggcggtgatccatgtcagaggtgaaagcccggggctcaactccggaattgcctttgaaacgggatcgctagagtccgagagaggatggcggaattcctagtgtagaggtgaaattcgtagatattaggaagaacaccggtggcgaaggcggccatctggctcggtactgacgctcaggcgcgaaagcgtggggagcaaacagg

SEQ ID NO: 619 - DNA, 253 bp, Unknown
  Description of Unknown: bacterium polynucleotide
  Alphaproteobacteria
tacgaagggggctagcgttgttcggaattactgggcgtaaagcgtgcgcaggcggcttctcaagtcaggggtgaaagcccagagctcaactctggaattgcctttgagactgagtggcttgagtgcgagagaggtgagtggaattcccagtgtagaggtgaaattcgtagatattgggaagaacaccggtggcgaaggcggctcactggctcgtaactgacgctcatgcacgacagcgtggggatcaaacagg

SEQ ID NO: 620 - DNA, 253 bp, Unknown
  Description of Unknown: bacterium polynucleotide
  Alphaproteobacteria
tacgtagggggctagcgttgttcggaattactgggcgtaaagcgcgcgcaggtggtctttcaagtcagtggtgaaagcccggagctcaactccggaaatgccattgaaactgtaagacttgaggatgagagaggtgagtggaattcccagtgtagaggtgaaattcgtagatattgggaagaacaccggtggcgaaggcggctcactggctcatatctgacgctcaggcgcgacagcgtggggatcaaacagg

SEQ ID NO: 621 - DNA, 253 bp, Unknown
  Description of Unknown: bacterium polynucleotide
  Alphaproteobacteria
tacgaagggggctagcgttgctcggaatcactgggcgtaaagcgcacgtaggcgggtccttaagtcaggggtgaaatcccggagctcaactccggaactgcctttgatactggggatcttgagtccggaagaggtgagtggaactccgagtgtagaggtgaaattcgtagatattcggaagaacaccagtggcgaaggcgactgactggacaagtattgacgctgaggtgcgaaagcgtggggagcaaacagg

SEQ ID NO: 622 - DNA, 253 bp, Unknown
  Description of Unknown: bacterium polynucleotide
  Alphaproteobacteria
tacgaagggggctagcgttgttcggaatcactgggcgtaaagcgcaagtaggcggttaagtaagttgggtgtgaaatccttggtttcaagctaagaactgcattcaaaactgcataactagagtacagtagggggtaatggaattccgagtgtaggggtggaatccttagatattcggaggaacaccagtagcgaaggcgtttacctgggctgttactggcgctgagttgcgaaagcatggggagcaaacagg

SEQ ID NO: 623 - DNA, 253 bp, Unknown
  Description of Unknown: bacterium polynucleotide
  Alphaproteobacteria
tacgaagggggctagcgttgttcggatttactgggcgtaaagcgcgcgtaggcggataaattagttagaggtgaaatcccggggctcaaccccggaactgcctttgatactgggtgtcttgagtgtggaagaggtcagtggaattgcgagtgtagaggtgaaattcgtagatattcgcaggaacaccagtggcgaaggcggctgactggtccacaactgacgctgaggtgcgaaagcgtggggagcaaacagg

SEQ ID NO: 624 - DNA, 253 bp, Unknown
  Description of Unknown: bacterium polynucleotide
  Alphaproteobacteria
gacggagggtgctagcgttgttcggaatcactgggcgtaaagggcgcgcaggcggccggtcgcgtcggacgtgaaagcccggggctcaaccccggaacggcgtccgatacgggcgggctcgaggccgggagaggggggtggaatacccagtgtagaggtgaaattcgtagatattgggtggaacaccggtggcgaaagcggccccctggcccggtcctgacgctgaggcgcgaaagcgtggggagcaaacagg

SEQ ID NO: 625 - DNA, 253 bp, Unknown
  Description of Unknown: bacterium polynucleotide
  Alphaproteobacteria
gacggagggggctagcgttgttcggaatgactgggcgtaaagggcgcgtaggctgttgtttaagtgaggcgtgaaagccctgggcttaacccaggaggtgcgtttcatactgaacgacttgagagcgagagaggaaagcggaattcctagtgtagaggtgaaattcgtagatattaggaagaacaccagaggcgaaggcggctttctggctcgcaactgacgctgaggcgcgaaagcgtggggagcaaacagg

SEQ ID NO: 626 - DNA, 253 bp, Unknown
  Description of Unknown: bacterium polynucleotide
  Alphaproteobacteria
gacagagggtgctagcgttgttcggaattactgggcgtaaagggcgcgtaggcggccatgtaagtcgggtgtgaaatcccggggctcaaccccggaatggcattcgatactgtgtggcttgagaccggaagaggtgggtggaatacccagtgtagaggtgaaattcgtagatattgggtggaacaccggtggcgaaggcggctcactggtccggttctgacgctgaggcgcgaaagcgtggggagcaaacagg

SEQ ID NO: 627 - DNA, 253 bp, Unknown
  Description of Unknown: bacterium polynucleotide
  Alphaproteobacteria
tacgaagggggctagcgttgttcggaattactgggcgtaaagcgcgcgcaggcggtcttccaggtcagcggtgaaagcctggagctcaactccagaactgccattgaaattgttagacttgagtacgagagaggtgagtggaattcccagtgtagaggtgaaattcgtagatattgggaagaacaccggtggcgaaggcggctcactggctcgtaactgacgctcaggcgcgacagcgtggggatcaaacagg

SEQ ID NO: 628 - DNA, 253 bp, Unknown
  Description of Unknown: bacterium polynucleotide
  Alphaproteobacteria
tacgaagggggctagcgttgttcggatttactgggcgtaaagggcacgcaggcggcctaacaagttgggggtgaaatcccggggcttaaccccggaactgccttcaaaactgttaggctagagatcgagagaggtgagtggaattcctagtgtagaggtgaaattcgtagatattaggaggaacaccagtggcgaaggcggctcactggctcgaatctgacgctcaggtgcgaaagcgtggggagcaaacagg

SEQ ID NO: 629 - DNA, 253 bp, Unknown
  Description of Unknown: bacterium polynucleotide
  Alphaproteobacteria
gacggagggtgctagcgttgttcggaattactgggcgtaaagggcgcgtaggcggcctggtcagtcggatgtgaaagcccggggctcaaccccggaacggcatccgagacggccaggctggagaccgggagaggagggtggaatagccagtgtagaggtgaaattcgtagatattggctggaacaccggtggcgaaagcggctctctggcccgggtctgacgctgaggcgcgaaagcgtggggagcaaacagg

SEQ ID NO: 630 - DNA, 253 bp, Unknown
  Description of Unknown: bacterium polynucleotide
  Alphaproteobacteria
tacgaaggtggcgaatgttgctcggattcactgggcgtaaagcgtccgtaggtggcttgttaagttagaggtgaaagccccgcgctcaacgtgggaattgcctttaaaactggcgagcttgagagtatcagaggtaggcggaataactggtgtagaggtaaaattcatagatatcagttggaacatccatggcgaaggcagcttactggggtatttctgacactgagaggcgacagcgtggggagcaaacagg

SEQ ID NO: 631 - DNA, 253 bp, Unknown
  Description of Unknown: bacterium polynucleotide
  Alphaproteobacteria
gacggagggtgctagcgttgttcggaattactgggcgtaaagggcgcgtaggcggccccttgcgtcgggtgtgaaagcccggggctcaaccccggaacggcacccgatacgggggggctcgagaccgagagaggtaggtggaatacccagtgtagaggtgaaattcgtagatattgggtggaacaccggtggcgaaagcggcccactggctcggttctgacgctgaggcgcgaaagcgtggggagcaaacagg

SEQ ID NO: 632 - DNA, 253 bp, Unknown
  Description of Unknown: bacterium polynucleotide
  Alphaproteobacteria
tacggagggggctagcgttgttcggaatgactgggcgtaaagggcgcgtaggtggttttttaagtgaggcgtgaaagccctgggcttaacctaggaggtgcgtttcatactgaaagacttgagtgcgagagaggaaagtggaattcctagtgtagaggtgaaatccgtagatattaggaagaacaccagaggcgaaggcggctttctggctcgcaactgacgctgaggcgcgaaagcgtggggagcaaacagg

SEQ ID NO: 633 - DNA, 253 bp, Unknown
  Description of Unknown: bacterium polynucleotide
  Alphaproteobacteria
tacgaagggggctagcgttgttcggatttactgggcgtaaagcgcacgtaggcggattgttaagtcgggggtgaaatcctggagctcaactccagaattgccttcgatactggctttctagaggctggaagaggttagtggaattcccagtgtagaggtgaaattcgtagatattgggaagaacaccagtggcgaaggcggctaactggtccagatctgacgctgaggcgcgaaagcgtggggagcaaacagg

SEQ ID NO: 634 - DNA, 253 bp, Unknown
  Description of Unknown: bacterium polynucleotide
  Alphaproteobacteria
tacgaagggggcaagcgttgctcggatttattgggcgtaaagggtgtgtaggcggctttgtaagttaggtgtgaaatcccggggcttaaccccggaactgcacttaagactgcagagcttgaagttcgaagaggttagcagaatttccagtgtagaggtgaaattcgtagatattggaaagaataccaatggcgtaggcagctaactggtcgacacttgacgctgaggcacgaaagcgtggggagcaaacagg

SEQ ID NO: 635 - DNA, 253 bp, Unknown
  Description of Unknown: bacterium polynucleotide
  Alphaproteobacteria
tacggagggggctagcgttgttcggaatgactgggcgtaaagggcgcgtaggcggtataataagtgaggcgtgaaagccctgggcttaacccaggaggtgcgtttcatactgttatgctagagtgcgagagaggaaagtggaattcctagtgtagaggtgaaattcgtagatattaggaagaacaccagaggcgaaggcggctttctggctcgcaactgacgctgaggcgcgaaagcgtgggtagcgaacagg

SEQ ID NO: 636 - DNA, 253 bp, Unknown
  Description of Unknown: bacterium polynucleotide
  Alphaproteobacteria
tacgaagggggctagcgttgttcggaattactgggcgtaaagcgcgcgtaggcggcgtgacaagttaggcgtgaaatgcctgggcttaacccaggaactgcgcttaagactgttatgctagagactaggagagggtggcggaattcccagtgtagaggtgaaattcgtagatattgggaagaacaccggttgcgaaggcggccacctggactagaactgacgctgaggtgcgaaagcgtggggagcaaacagg

SEQ ID NO: 637 - DNA, 253 bp, Unknown
  Description of Unknown: bacterium polynucleotide
  Alphaproteobacteria
tacggagggagctagcgttgttcggaattactgggcgtaaagcgtacgtaggcggttattcaagtcagaggtgaaagcctggagctcaactccagaactgcctttgaaactagatagctagaatcttggagaggtgagtggaattccgagtgtagaggtgaaattcgtagatattcggaagaacaccagtggcgaaggcgactcactggacaagtattgacgctgaggtacgaaagcgtggggagcaaacagg

SEQ ID NO: 638 - DNA, 253 bp, Unknown
  Description of Unknown: bacterium polynucleotide
  Alphaproteobacteria
gacggagggggctagcgttgttcggaatgactgggcgtaaagggtgcgtaggcggttttttaagtgaggcgtgaaagccctgggcttaacccaggaattgcgtttcagactggaaagcttgagtacgagagaggtaagtggaattcctagtgtagaggtgaaattcgtagatattaggaagaacaccagtggcgaaggcggcttactggctcgtaactgacgctgaggcacgaaagcgtggggggcaaacagg

SEQ ID NO: 639 - DNA, 253 bp, Unknown
  Description of Unknown: bacterium polynucleotide
  Alphaproteobacteria
tacgaagggggctagcgttgttcggaattactgggcgtaaagcgcacgtaggcggacatttaagtcaggggtgaaatcccggggctcaacctcggaactgcctttgatcctgggtgtcttgagtatggaagaggtaagtggaattgcgagtgtagaggtgaaattcgtagatattcgcaggaacaccagtggcgaaggcggcttactggtccagatctgacgctgaggtgcgaaggcgtgaggagcgaacagg

SEQ ID NO: 640 - DNA, 253 bp, Unknown
  Description of Unknown: bacterium polynucleotide
  Alphaproteobacteria
tacgaagggggcgagcgttattcggaatcactgggcgtaaagcgtgcgtaggctgcttggaaagttgggagtgaaagcccagggctcaaccctggaattgctctcaaaactaccaggctcggattcgggagaggatagcggaattgtcagtgtagcagtgaaatgcgtagatattgacaggaacaccagtggcgcaagcggctatctggaccgacatcgacgctgaggcacgaaagcgtggggatcaaacagg

SEQ ID NO: 641 - DNA, 253 bp, Unknown
  Description of Unknown: bacterium polynucleotide
  Alphaproteobacteria
tacggagggggctagcgttgttcggaattactgggcgtaaagggcacgtaggctggctgttaagtcggtggtgaaatgctgaggctcaacctcagaattgccttcgatactgacggtcttgagtgcgggagaggtgagtggaattcccagtgtagaggtgaaattcgtagatattgggaagaacaccagtggcgaaggcggctcactggcccgcaactgacgctgaggtgcgaaagcgtggggagcaaacagg

SEQ ID NO: 642 - DNA, 253 bp, Unknown
  Description of Unknown: bacterium polynucleotide
  Alphaproteobacteria
tacgaagggggctagcgttgttcggaattactgggcgtaaagcgtgcgcaggcggccatttaagtcaggggtgaaagcccagagctcaactctggaattgcctttgaaactatttggcttgagtgcgggagaggtgagtggaattcccagtgtagaggtgaaattcgtagatattgggaagaacaccggtggcgaaggcggctcactggcccgtttctgacgctcatgcacgatagcgtggggatcaaacagg

SEQ ID NO: 643 - DNA, 253 bp, Unknown
  Description of Unknown: bacterium polynucleotide
  Alphaproteobacteria
tacgaatggggcaagcgttgttcggaatcactgggcttaaagcgtgcgtaggcggatttgcaagtcaggagtgaaatcccagggctcaaccctggaattgcttttgaaactgcaaatctagaagattgaagaggttagcagaattccgagagtagaggtgaaattcgcagatattcggaggaataccaatggcgcaggcagctaactgggcaatttttgacgctgaggcacgaaagcgtggggagcaaacagg

SEQ ID NO: 644 - DNA, 254 bp, Unknown
  Description of Unknown: bacterium polynucleotide
  Alphaproteobacteria
gacggagggtgctagcgttgttcggaatcactgggcgtaaagggcgcgtaggcggccttggcagtcggcttgtgaaagcccggggctcaaccccggaggtgcggccgatacaccgaggctcgaggccggaagaggagggtagaatacccagtgtagaggtgaaattcgtagatattgggtggaacaccggtggcgaaagcggctctctggtccggacctgacgctgaggcgcgaaagcgtggggagcaaacagg

SEQ ID NO: 645 - DNA, 253 bp, Unknown
  Description of Unknown: bacterium polynucleotide
  Alphaproteobacteria
tacgaagggtgctagcgttgttcggaatcactgggcgtaaagcgcgcgtaggcggcgtcgcaagtcagaggtgaaagcctggagctcaactccagaattgcctttgaaactgcgatgctagagtgtcggaggggatagcggaattcctaatgtagaggtgaaattcgtagatattaggaggaacaccggtggcgaaggcggctatctggacgacaactgacgctgaggcgcgaaagcgtggggatcaaacagg

SEQ ID NO: 646 - DNA, 253 bp, Unknown
  Description of Unknown: bacterium polynucleotide
  Alphaproteobacteria
tacgaagggggctagcgttgttcggaattactgggcgtaaagcgcgcgcaggcggtccttccagtcagaggtgaaagcccagagctcaactctggaactgcctttgaaactagaggacttgggtacgggagaggtgagtggaattccgagtgtagaggtgaaattcgtagatattcggaagaacaccagtggcgaaggcggctcactggcccgttaccgacgctcaggcgcgacagcgtggggagcaaacagg

SEQ ID NO: 647 - DNA, 253 bp, Unknown
  Description of Unknown: bacterium polynucleotide
  Alphaproteobacteria
tacgaagggggctagcgttgttcggaatcactgggcgtaaagcgcacgtaggcggaccattaagtcaggggtgaaagcctggagctcaactccagaactgcctttgatactgatggtctcgagtatggaagaggttggtggaactgcgagtgtagaggtgaaattcgtagatattcgcaagaacaccagtggcgaaggcggccaactggtccattactgacgctgaggtgcgaaagcgtggggagcaaacagg

SEQ ID NO: 648 - DNA, 253 bp, Unknown
  Description of Unknown: bacterium polynucleotide
  Alphaproteobacteria
gacggagggggctagcgttgttcggaatgactgggcgtaaagggcgcgtaggcggttgattaagttagacgtgaaagcctcaggctcaacctgagaacggcgtttgatactggtcgacttgaggacgagagaggaaagtggaattccgagtgtagaggtgaaattcgtagatattcgtaggaacatcagaagcgaaggcggctttctggctcgtccctgacgctgaggcgcgaaagcgtggggagcaaacagg

SEQ ID NO: 649 - DNA, 253 bp, Unknown
  Description of Unknown: bacterium polynucleotide
  Alphaproteobacteria
tacgaagggggctagcgttgttcggaattactaggcgtaaagcgcgcgcaggcggtcttccaagtcagtggtgaaagcccggagctcaactccggaactgccattgaaactgtgagacttgagtacgagagaggtgagtggagttcccagtgtagaggtgaaattcgtagatattgggaagaacaccggtggcgaaggcggctcactggctcgtaactggcgctcaggcgcgacagcgtggggatcaaacagg

SEQ ID NO: 650 - DNA, 253 bp, Unknown
  Description of Unknown: bacterium polynucleotide
  Alphaproteobacteria
tacgaagggggcgagcgttattcggaatcactgggcgtaaagcgtgcgtaggctgtctagaaagttggaagtgaaagcccagggctcaaccctggaattgctttcaaaactactagactcggatttgggagaggatagcggaattgtcagtgtagcagtgaaatgcgtagatattgacaggaacaccagtggcgcaagcggctatctggaccaacatcgacgctgaggcacgaaagcgtggggatcaaacagg

SEQ ID NO: 651 - DNA, 253 bp, Unknown
  Description of Unknown: bacterium polynucleotide
  Alphaproteobacteria
gacggggggggctagcgttgttcggaattactgggcgtaaagcgcgcgcaggtggtttctcaagtcggtggtgaaagcccggagctcaactccggaactaccattgaaactgtggaactcgaggacgagagaggtgagtggaattcccagtgtagaggtgaaattcgtagatattgggaagaacaccggtggcgaaggcggctcactggctcctatctgacactcaagcgcgacagcgtggggatcaaacagg

SEQ ID NO: 652 - DNA, 253 bp, Unknown
  Description of Unknown: bacterium polynucleotide
  Alphaproteobacteria
tacgaagggggctagcgttgttcggaattactgggcgtaaagggcgcgtaggcggatttgcaagttaggggtgaaatcccggggctcaaccccggaactgcctctaaaactgctaatctagagttcgggagaggtgagtggaattccgagtgtagaggtgaaatgcgtagatatcaggaggaacacctgtggcgtaagcgcctgtctggccatgacctgacgctgtggcacgaaagcgtggggagcaaacagg

SEQ ID NO: 653 - DNA, 253 bp, Unknown
  Description of Unknown: bacterium polynucleotide
  Alphaproteobacteria
tacgaagggtgctagcgttgttcggaatcactgggcgtaaagcgcgcgtaggtggctcagtaagtcaggggtgaaatcctggggctcaaccccagaactgcccttgaaactattgagcttgagtgtcggaggggatagcggaattgctaatgtagaggtgaaattcgtagatattagcaggaacaccggtggcgaaggcggctatctggacgacaactgacactgaggcgcgaaagcgtggggatcaaacagg

SEQ ID NO: 654 - DNA, 253 bp, Unknown
  Description of Unknown: bacterium polynucleotide
  Alphaproteobacteria
tacgaagggggcgagcgttattcggaatcactgggcgtaaagcgtgcgtaggctgcttagagagttgggagtgaaagcccagggctcaaccctggaattgctctcaaaactactaggctcgaatatcggagaggatagcggaattgtcagtgtagcagtgaaatgcgtagatattgacaggaacaccagtggtgtaagcggctatctggacgattattgacgctgaggcacgaaagcgtggggatcaaacagg

SEQ ID NO: 655 - DNA, 253 bp, Unknown
  Description of Unknown: bacterium polynucleotide
  Alphaproteobacteria
gacggagggggctagcgttgttcggaatgactgggcgtaaaggacatgtaggttgttaactaagtcaggcgtgaaagccctgggctcaacccaggaactgcgtctgagactggttagctagagtatagtagaggaatgtggaattccgagtgtagaggtgaaattcgtagatattcggaggaacatctgaggcgaaggcgacattctgggctataactgacactgaaatgtgacagcgtggggagcaaacagg

SEQ ID NO: 656 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggttgacacagtcaggcgtgaaattcctgggcttaacctgggggctgcgcttgatacatgttgacttgagtgtggaagagggtcgtggaattcccagtgtagaggtgaaattcgtagatattgggaagaacaccggtggcgaaggcggcgacctggtccattactgacgctgaggtgcgaaagcgtggggagtaaacagg

SEQ ID NO: 657 - DNA, 253 bp, Unknown
  Description of Unknown: bacterium polynucleotide
  Alphaproteobacteria; Acetobacteraceae
tacgaagggggctagcgttgctcggattgactgggcgtaaagggcgcgtaggcggtttgcatagtcagacgtgaaattcctgggcttaacctgggggctgcgtttgatacatgcaggcttgagttcggaagagggtcgtggaattcccagtgtagaggtgaaattcgtagatattgggaagaacaccggtggcgaaggcggcgacctggtccgatactgacgctgaggcgcgaaagcgtggggagcaaacggg

SEQ ID NO: 658 - DNA, 253 bp, Unknown
  Description of Unknown: bacterium polynucleotide
  Alphaproteobacteria; Acetobacteraceae
tacgaagggggctagcgttgcccggaatgactgggcgtaaagggcgcgtaggcggttcacgcagtcagatgtgaaattcctgggcttaacctgggggctgcatttgagacgcgtgggcttgagtatgaaagagggtcgtggaattcccagtgtagaggtgaaattcgtagatattgggaagaacaccggtggcgaaggcggcgacctggttcatgactgacgctgaggcgcgaaagcgtggggagcaaacagg

SEQ ID NO: 659 - DNA, 254 bp, Unknown
  Description of Unknown: bacterium polynucleotide
  Alphaproteobacteria; Acetobacteraceae
tacgaagggggctagcgttgctcggaatgactgggcgtaaagggcgcgtaggcggttttcgcagtcagatgtgaaattcccgggcttaacctgggggctgcatttgagacgcggggacttgagtggggaagagggtcgtggaattcccagtgtagaggtgaaattcgtagatattgggaagaacaccggtggcgaaggcggcgacctggtccttgaactgacgctgaggcgcgaaagcgtggggagcaaacagg

SEQ ID NO: 660 - DNA, 253 bp, Unknown
  Description of Unknown: bacterium polynucleotide
  Alphaproteobacteria; Acetobacteraceae
tacgaagggggctagcgttgctcggaattactgggcgtaaagggcgcgtaggcggcttggccagtcaggcgtgaaattcctgggcttaacctggggactgcgcttgatactgctaagcttgaggccgagagagggtggtggaattcccagtgtagaggtgaaattcgtagatattgggaagaacaccggtggcgaaggcgaccacctggctcggtactgacgctgaggcgcgacagcgtggggagcaaacagg

SEQ ID NO: 661 - DNA, 253 bp, Unknown
  Description of Unknown: bacterium polynucleotide
  Alphaproteobacteria; Acetobacteraceae
tacgaagggggctagcgttactcggaattactgggcgtaaagggcgcgtaggcggcgctccaagttaggcgtgaaagtcctgggctcaacctgggaactgcgcttaagactggagtgcttgaggatggaagagggtcgtggaattcccagtgtagaggtgaaattcgtagatattgggaagaacaccggtggcgaaggcggcgacctggtccattactgacgctgaggcgcgacagcgtggggagcaaacagg

SEQ ID NO: 662 - DNA, 253 bp, Unknown
  Description of Unknown: bacterium polynucleotide
  Alphaproteobacteria; Acetobacteraceae
tacgaagggggctagcgttgctcggaattactgggcgtaaagggcgcgtaggcggtcattttagtcaggcgtgaaattcccgggcttaacctggggactgcgcttgatactgggtgacttgagggtggaagagggtcgtggaattcccagtgtagaggtgaaattcgtagatattgggaagaacaccggtggcgaaggcggcgacctggtccattactgacgctgaggcgcgacagcgtggggagcaaacagg

SEQ ID NO: 663 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggaatgctttgtcgggcgtgaaattccagggcttaaccttgggactgcgttcgagacgggtattctaaagtggagaagagggtcgtggaattcccagtgtagaggtgaaattcgtagatattgggaagaacaccggtggcgaaggcggcgacctggtcttttactgacgctgaggcgcgaaagcgtggggagcaaacagg

SEQ ID NO: 664 - DNA, 253 bp, Unknown
  Description of Unknown: bacterium polynucleotide
  Alphaproteobacteria; Acetobacteraceae
tacgaagggggctagcgttgctcggaattactgggcgtaaagggcgcgtaggcggcgcagttagtcaggcgtgaaattcctgggcttaacctggggactgcgcttgatacggctgtgctagagggtggaagaggctcgcggaattcccagtgtagaggtgaaattcgtagatattgggaagaacaccggtggcgaaggcggcgagctggtccattactgacgctgaggcgcgacagcgtggggagcaaacagg

SEQ ID NO: 665 - DNA, 253 bp, Unknown
  Description of Unknown: bacterium polynucleotide
  Alphaproteobacteria; Acetobacteraceae
tacgaagggggctagcgttgctcggaatgactgggcgtaaaggtcgcgtaggcggttcgtacagtcagacatgaaattcccgggctcaacctggggactgcgtttgatacgtacgggcttgagttcggaagagggtcgtggaattcccagtgtagaggtgaaattcgtagatattgggaagaacactggtggcgaaggcggcgacctggtccgatactgacgctgaggcgcgaaagcgtggggagcaaacagg

SEQ ID NO: 666 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggctgtcacagtcagaagtgaaattcctgggctcaacctggggactgcttttgatacgtggcggcttgagtggggaagagggttgcggaatttccagtgtagaggtgaaatgcgtagatatcggaaggaacaccagtggcgaaggcggctacctggcttgatactgacactgaggcgcgagagcgtggggagcaaacagg

SEQ ID NO: 667 - DNA, 252 bp, Unknown
  Description of Unknown: bacterium polynucleotide
  Alphaproteobacteria; Acetobacteraceae
tacgagggggctagcgttgcccggaatgactgggcgtaaagggcgcgtaggcggatggcacagtcagatgtgaaattcccgggcttaacctgggggctgcatttgatacgtgcgggcttgagttcggaagagggtcgtggaattcccagtgtagaggtgaaattcgtagatattgggaagaacaccggtggcgaaggcggcgacctggtccgatactgacgctgaggcgcgaaagcgtggggagcaaacagg

SEQ ID NO: 668 - DNA, 253 bp, Unknown
  Description of Unknown: bacterium polynucleotide
  Alphaproteobacteria; Acetobacteraceae
tacgaagggggctagcgttgctcggattgactgggcgtaaagggcgcgtaggcggtttgtacagtcagacgtgaaattcctgggctcaacctgggggctgcgtttgatacgtgcagacttgagttcggaagagggtcgtggaattcccagtgtagaggtgaaattcgtagatattaggaagaacaccggtggcgaaggcggcccactggatcggtactgacgctgaggtgcgaaagcgtggggagcaaacagg

SEQ ID NO: 669 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggattggtcagtcgggcgtgaaattcctgggcttaacctgggggctgcgttcgagacggcgggtcttgagtttggaagagggtcgtggaattcccagtgtagaggtgaaattcgtagatattgggaagaacaccggtggcgaaggcggcgacctggtcctggactgacgctgaggcgcgaaagcgtggggagcaaacagg

SEQ ID NO: 670 - DNA, 253 bp, Unknown
  Description of Unknown: bacterium polynucleotide
  Alphaproteobacteria; Acetobacteraceae
tacgaagggggcgagcgttgctcggaatgactgggcgtaaagggcgcgtaggcggaccccgcagtcgggcgtgaaatccccgggctcaacccgggacgtgcgcccgagacgcggggtctggagtgggggagagggtcgcggaattcccagtgtagaggtgaaattcgtagatattgggaagaacaccggtggcggaggcggcgacctggccctttactgacgctgaggcgcgacagcgtggggagcaaacagg

SEQ ID NO: 671 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggattggttagtcagacgtgaaattcctgggctcaacctgggggctgcgttcgatacggctgatctagagtttggaagagggtcgtggaattcccagtgtagaggtgaaattcgtagatattgggaagaacaccggtggcgaaggcggcgacctggtccttgactgacgctgaggcgcgaaagcgtggggagcaaacagg

SEQ ID NO: 672 - DNA, 253 bp, Unknown
  Description of Unknown: bacterium polynucleotide
  Alphaproteobacteria; Acetobacteraceae
tacgaagggggctagcgttgctcggaattactgggcgtaaagggcgcgtaggcggcttagttagtcaggcgtgaaattcctgggctcaacctggggactgcgcttgatacggctaggctagaggatggaagagggtcgcggaattcccagtgtagaggtgaaattcgtagatattgggaagaacaccggtggcgaaggcggcgacctggtccattactgacgctgaggcgcgacagcgtggggagcaaacagg

SEQ ID NO: 673 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggattgcgcagtcagatgtgaaattcctgggcttaacctgggggctgcatttgagacgcgtagtctagagtgtgaaagagggtcgtggaattcccagtgtagaggtgaaattcgtagatattgggaagaacaccggtggcgaaggcggcgacctggttcataactgacgctgaggcgcgaaagcgtggggagcaaacagg

SEQ ID NO: 674 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggacggcttagtcaggcgtgaaagtcctgggctcaacctggggattgcgcttgatacgggttgtctagagttgggaagagggtcgtggaattcccagtgtagaggtgaaattcgtagatattgggaagaacaccggtggcgaaagcggcgggctggacctctactgacgctgaggcgcgaaagccaggggagcaaacggg

SEQ ID NO: 675 - DNA, 253 bp, Unknown
  Description of Unknown: bacterium polynucleotide
  Alphaproteobacteria; Acetobacteraceae
tacgaagggggctagcgttactcggaattactgggcgtaaagggcgcgtaggcggcgttccaagttaggcgtgaaagtcctgggctcaacctgggaactgcgcttaagactggaatgctagaggatggaagagggttgtggaactcccagtgtagaggtgaaattcgtagatattgggaagaacaccggtggcgaaggcggcaacctggtccatttctgacgctgaggcgcgatagcgtggggagcaaacagg

SEQ ID NO: 676 - DNA, 253 bp, Unknown
  Description of Unknown: bacterium polynucleotide
  Alphaproteobacteria; Acetobacteraceae
tacgaagggggctagcgttgctcggaatcattgggcgtaaagggcgcgtaggcggcgctgttagtcaggcgtgaaatgcccaggctcaacctggggactgcgcttgatacggcagggctcgaggatggaagagggccgcggaattcccagtgtagaggtgaaattcgtagatattgggaagaacaccggtggcgaaggcggcggcctggtccatttctgacgctgaggcgcgacagcgtggggagcaaacagg

SEQ ID NO: 677 - DNA, 253 bp, Unknown
  Description of Unknown: bacterium polynucleotide
  Alphaproteobacteria; Acetobacteraceae
tacgaagggggctagcgttgctcggaattactgggcgtaaagggcgcgtaggcggcgcggttagtcaggcgtgaaattcccgggctcaacccggggactgcgtttgatacggccgtgctcgaggatggaagagggccgcggaattcccagtgtagaggtgaaattcgtagatattgggaagaacaccggtggcgaaggcggcggcctggtccattactgacgctgaggcgcgacagcgtggggagcaaacagg

SEQ ID NO: 678 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggcttgtttagtcaggcgtgaaattcctgggcttaacctgggggctgcgcttgatacaggcaggcttgagtgcggaagagggtcgtggaattcccagtgtagaggtgaaattcgtagatattgggaagaacaccggtggcgaaggcggcgacctggtccgtgactgacgctgaggcgcgaaagcgtggggagcaaacagg

SEQ ID NO: 679 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggctcatacagtcaggcgtgaaattcctgggctcaacctggggactgcgcttgagacgtgtgggcttgagtggggaagagggtcgtggaattcccagtgtagaggtgaaattcgtagatattgggaagaacaccggtggcgaaggcggcgacctggtccttgactgacgctgaggcgcgaaagcgtggggagcaaacagg

SEQ ID NO: 680 - DNA, 253 bp, Unknown
  Description of Unknown: bacterium polynucleotide
  Alphaproteobacteria; Acetobacteraceae
tacgaagggggctagcgttgctcggaatgactgggcgtaaagggcgcgtaggcggcgcggtcagtcgggcgtgaaagccccgggctcaacctggggactgcgctcgagacggccgtgctagaggacggaagaggctcgcggaattcccagtgtagaggtgaaattcgtagatattgggaagaacaccggtggcgaaggcggcgagctggtccgttactgacgctgaggcgcgacagcgtggggagcaaacagg

SEQ ID NO: 681 - DNA, 253 bp, Acetobacter sp.
  Alphaproteobacteria; Acetobacteraceae; Acetobacter
tacgaagggggctagcgttgctcggaatgactgggcgtaaagggcgtgtaggcggttttgacagtcagatgtgaaacccccgggcttaacctgggagctgcatttgagacgctaagactagagtgtgagagagggttgtggaattcccagtgtagaggtgaaattcgtagatattgggaagaacaccggtggcgaaggcggcaacctggctcattactgacgctgaggcgcgaaagcgtggggagcaaacagg

SEQ ID NO: 682 - DNA, 253 bp, Acetobacter sp.
  Alphaproteobacteria; Acetobacteraceae; Acetobacter
tacgaagggggctagcgttgctcggaatgactgggcgtaaagggcgcgtaggcggttgacacagtcaggtgtgaaattcccgggcttaacctgggggctgcatttgagacgtgttgactagagtgtgagagagggttgtggaattctcagtgtagaggtgaaattcgtagatattgggaagaacaccggtggcgaaggcggcaacctggctcataactgacgctgaggcgcgaaagcgtggggagcaaacagg

SEQ ID NO: 683 - DNA, 253 bp, Acetobacter sp.
  Alphaproteobacteria; Acetobacteraceae; Acetobacter
tacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcataactgacgctgaggcgcgaaagcgtggggagcaaacagg

SEQ ID NO: 684 - DNA, 253 bp, Acetobacter sp.
  Alphaproteobacteria; Acetobacteraceae; Acetobacter
tacgaagggggctagcgttgctcggaatgactgggcgtaaagggcgtgtaggcggttgatacagtcagatgtgaaatccccgggcttaacctgggagctgcatttgaggcgtattgactagagtgtgagagagggttgtggaattcccagtgtagaggtgaaattcgtagatattgggaagaacaccggtggcgaaggcggcaacctggctcattactgacgctgaggcgcgaaagcgtggggagcaaacagg

SEQ ID NO: 685 - DNA, 253 bp, Acidocella sp.
  Alphaproteobacteria; Acetobacteraceae; Acidocella
tacgaagggggctagcgttgctcggaatgactgggcgtaaagggcgcgtaggcggtttgtacagtcagatgtgaaattcctgggctcaacctggggactgcatttgatacgtgcagacttgagtgaagaagagggtcgtggaatttccagtgtagaggtgaaattcgtagatattggaaagaacaccggtggcgaaggcggcgacctggtctttaactgacgctgaggcgcgaaagcgtggggagcaaacagg

SEQ ID NO: 686 - DNA, 253 bp, Craurococcus roseus
  Alphaproteobacteria; Acetobacteraceae; Craurococcus roseus
tacgaagggggctagcgttgctcggaatcactgggcgtaaagggcgcgtaggcggcgccgaaagtcgggcgtgaaatccccgggctcaacccgggggctgcgcccgagactgcggtgctcgaggacgggagaggctcgcggaattcccagagtagaggtgaaattcgtagatattgggaagaacaccggtggcgaaggcggcgagatggcccgtttctgacgctgaggcgcgacagcgtggggagcaaacagg

SEQ ID NO: 687 - DNA, 253 bp, Craurococcus roseus
  Alphaproteobacteria; Acetobacteraceae; Craurococcus roseus
tacgaagggggctagcgttgctcggaatcactgggcgtaaagggcgcgtaggcggcgcttctagtcgggcgtgaaatccccgggctcaacccgggggctgcgctcgatacgggggcgctggaggacgggagaggctcgcggaattcctagagtagaggtgaaattcgtagatattgggaagaacaccggtggcgaaggcggcgagctggcccgtttctgacgctgaggcgcgacagcgtggggagcaaacagg

SEQ ID NO: 688 - DNA, 253 bp, Gluconacetobacter diazotrophicus
  Alphaproteobacteria; Acetobacteraceae; Gluconacetobacter diazotrophicus
tacgaagggggctagcgttgctcggaatgactgggcgtaaagggcgcgtaggcggtatggacagtcagatgtgaaattcctgggcttaacctgggggctgcatttgatacgtccaaactagagtgtgagagagggttgtggaattcccagtgtagaggtgaaattcgtagatattgggaagaacaccggtggcgaaggcggcaacctggctcataactgacgctgaggcgcgaaagcgtggggagcaaacagg

SEQ ID NO: 689 - DNA, 253 bp, Gluconobacter sp.
  Alphaproteobacteria; Acetobacteraceae; Gluconobacter
tacgaagggggctagcgttgctcggaatgactgggcgtaaagggcgcgtaggcggttgatgcagtcagatgtgaaatccccgggcttaacctgggaactgcatttgagacgcattgactagagttcgagagagggttgtggaattcccagtgtagaggtgaaattcgtagatattgggaagaacaccggtggcgaaggcggcaacctggctcgatactgacgctgaggcgcgaaagcgtggggagcaaacagg

SEQ ID NO: 690 - DNA, 254 bp, Rhodopila globiformis
  Alphaproteobacteria; Acetobacteraceae; Rhodopila globiformis
tacgaagggggctagcgttgctcggaatgactgggcgtaaagggcgcgtaggcggtttgtacagtcaggtgtgaaattcccgggctcaacctgggggctgcacttgatacgtatggacttgagtgaggaagagggtcgtggaattcccagtgtagaggtgaaattcgtagatattgggaagaacacctgtggcgaaggcggcgacctggtccttttactgacgctgaggcgcgaaagcgtggggagcaaacagg

SEQ ID NO: 691 - DNA, 253 bp, Roseomonas sp.
  Alphaproteobacteria; Acetobacteraceae; Roseomonas
tacgaagggggctagcgttgctcggaattactgggcgtaaagggcgcgtaggcggctctgttagtcaggcgtgaaattcccgggctcaacctggggactgcgcttgatactgcggagcttgaggatggaagaggctcgtggaattcccagtgtagaggtgaaattcgtagatattgggaagaacaccggtggcgaaggcggcgagctggtccattactgacgctgaggcgcgacagcgtggggagcaaacagg

SEQ ID NO: 692 - DNA, 254 bp, Roseomonas aerilata
  Alphaproteobacteria; Acetobacteraceae; Roseomonas aerilata
tacgaagggggctagcgttgctcggaattactgggcgtaaagggcgcgtaggcggcctggtgagtgaggcgtgaaattcccgggcttaacctggggactgcgcttcatactgctgggctagagggtggaagagggtcgtggaattcccagtgtagaggtgaaattcgtagatattgggaagaacaccggtggcgaaggcggcgacctggtccattactgacgctgaggcgcgacagcgtgggggagcaaacagg

SEQ ID NO: 693 - DNA, 253 bp, Swaminathania sp.
  Alphaproteobacteria; Acetobacteraceae; Swaminathania
tacgaagggggctagcgttgctcggaatgactgggcgtaaagggcgcgtaggcggtttacacagtcagatgtgaaattccagggcttaaccttggggctgcatttgatacgtgtagactagagtgtgagagagggttgtggaattcccagtgtagaggtgaaattcgtagatattgggaagaacaccggtggcgaaggcggcaacctggctcattactgacgctgaggcgcgaaagcgtggggagcaaacagg

SEQ ID NO: 694 - DNA, 253 bp, Unknown
  Description of Unknown: bacterium polynucleotide
  Alphaproteobacteria; Aurantimonadaceae
tacgaagggggctagcgttgttcggaattactgggcgtaaagcgcacgtaggcggacatttaagtcaggggtgaaatcccggggctcaaccccggaactgcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacagg

SEQ ID NO: 695 - DNA, 253 bp, Unknown
  Description of Unknown: bacterium polynucleotide
  Alphaproteobacteria; Aurantimonadaceae
tacgaagggggctagcgttgttcggaattactgggcgtaaagcgcacgtaggcggacatttaagtcaggggtgaaatcccggggcccaaccccggaactgcctttgatactgggtgtcttgagtgtggtagaggtgagtggaattgcgagtgtagaggtgaaattcgtagatattcgcaggaacaccggtggcgaaggcggctcactggaccacaactgacgctgaggtgcgaaagcgtggggagcaaacagg

SEQ ID NO: 696 - DNA, 253 bp, Unknown
  Description of Unknown: bacterium polynucleotide
  Alphaproteobacteria; Aurantimonadaceae
tacgaagggggctagcgttgttcggaattactgggcgtaaagcgcacgtaggcggatatttaagtcaggggtgaaatcccggggctcaaccccggaacggcctttgatactggatgtcttgagtccggaagaggtgagtggaactgcgagtgtagaggtggaattcgtagatattcgcaggaacaccagtggcgaaggcggctcactggtccggaactgacgctgaggtgcgaaagcgtggggagcaaacagg

SEQ ID NO: 697 - DNA, 253 bp, Unknown
  Description of Unknown: bacterium polynucleotide
  Alphaproteobacteria; Bartonellaceae
tacgaagggggctagcgttgttcggatttactgggcgtagagcgcgcgtaggcggataaattagttagaggtgaaatcccagggctcaaccctggaactgcctttaatactgtttatctagagtatgagagaggtgagtggaattccgagtgtagaggtgaaattcgtagatattcggaggaacatcagtggcgaaggcggctcactggttcattactgacgctgaggtgcgaaagcgtggggagcaaacagg

SEQ ID NO: 698 - DNA, 253 bp, Unknown
  Description of Unknown: bacterium polynucleotide
  Alphaproteobacteria; Beijerinckiaceae
tacgaagggggctagcgttgctcggaatcactgggcgtaaagggcgcgtaggcggccgttcaagtcagaggtgaaagctcaaggctcaaccttggaattgcctttgatactgttcggctagagaccggaagaggtaagtggaactgcgagtgtagaggtgaaattcgtagatattcgcaagaacaccagtggcgaaggcggcttactggtccggttctgacgctgaggcgcgaaagcgtggggagcaaacagg

SEQ ID NO: 699 - DNA, 253 bp, Unknown
  Description of Unknown: bacterium polynucleotide
  Alphaproteobacteria; Beijerinckiaceae
tacgaagggggctagcgttgctcggaatcactgggcgtaaagggcgcgtaggcggccattcaagtcagaggtgaaagcccaaggctcaaccttggaattgcctttgatactgtttggcttgagaccggaagaggttagtggaactgcgagtgtagaggtgaaattcgtagatattcacaaggacaccagtggcgaaggcggctaactggtccggttctgacgctgaggcgcgaaagcgtggggagcaaacagg

SEQ ID NO: 700 - DNA, 253 bp, Unknown
  Description of Unknown: bacterium polynucleotide
  Alphaproteobacteria; Beijerinckiaceae
tacggagggggctagcgttgttcggaatcactgggcgtaaagggcgcgtaggcggacgtttaagtcaggggtgaaatcccggggctcaacctcggaattacctttgatactggatgtctcgagaccggaagaggtaagtggaactgcgagtgtagaggtgaaattcgtagatattcgcaagaacaccagtggcgaaggcggcttactggtccggttctgacgctgaggcgcgaaagcgtggggagcaaacagg

SEQ ID NO: 701 - DNA, 253 bp, Unknown
  Description of Unknown: bacterium polynucleotide
  Alphaproteobacteria; Beijerinckiaceae
tacgaagggggctagcgttgctcggaatcactgggcgtaaagggcgcgtaggcggacttttaagtcaggggtgaaagcctgaggctcaacctcagaattgcctttgatactggaagtcttgagaccggaagaggttagtggaactgcgagtgtagaggtgaaattcgtagatattcgcaagaacaccagtggcgaaggcggctaactggtccggttctgacgctgaggcgcgaaagcgtggggagcaaacagg

SEQ ID NO: 702 - DNA, 253 bp, Unknown
  Description of Unknown: bacterium polynucleotide
  Alphaproteobacteria; Beijerinckiaceae
tacgaagggggctagcgttgctcggaatcactgggcgtaaagggcgcgtaggcggatctttaagtcgggggtgaaagcccagggctcaaccctggaattgccttcgatactgaagatcttgagaccggaagaggtaagtggaactgcgagtgtagaggtgaaactcgtagatattcgcaagaacaccagtggcgaaggcggctgactggtccggttctgacgctgaggcgcgaaagcgtggggagcaaacagg

SEQ ID NO: 703 - DNA, 253 bp, Beijerinckia sp.
  Alphaproteobacteria; Beijerinckiaceae; Beijerinckia
tacgaagggggctagcgttgttcggaatcactgggcgtaaggcgcacgtaggcggacgcttaagtcaggggtgaaatgccgaggctcaacctcggaactgcctttgatactgggtgtcttgagtccgggagaggtgagtggaactgcgagtgtagaggtgaaattcgtagatattcgcaagaacaccagtggcgaaggcggctcactggcccggaactgacgctgaggtgcgaaagcgtggggagcaaacagg

SEQ ID NO: 704 - DNA, 253 bp, Unknown
  Description of Unknown: bacterium polynucleotide
  Alphaproteobacteria; Bradyrhizobiaceae
tacgaagggggctagcgttgttcggaatcactgggcgtaaagggcgcgtaggcggccgttcaagtcgggggtgaaagcctgtggctcaaccacagaatggccttcgatactggacggctcgagaccggaagaggtcagtggaactgcgagtgtagaggtgaaattcgtagatattcgcaagaacaccagcggcgaaggcggctgactggtccggttctgacgctgaggcgcgaaagcgtggggagcaaacagg

SEQ ID NO: 705 - DNA, 253 bp, Unknown
  Description of Unknown: bacterium polynucleotide
  Alphaproteobacteria; Bradyrhizobiaceae
tacgaagggggctagcgttgctcggaatcaccgggcgtaaagggcgcgtaggcggccgatcaagtcaggggtgaaagcctgtggctcaaccacagaattgcctttgatactgttcggctcgagaccggaagaggttggtggaactgcgagtgtagaggtgaaattcgtagatattcgcaagaacaccagtggcgaaggcggccaactggtccggttctgacgctgaggcgcgaaagcgtggggagcaaacagg

SEQ ID NO: 706 - DNA, 253 bp, Balneimonas sp.
  Alphaproteobacteria; Bradyrhizobiaceae; Balneimonas
tacgaagggggctagcgttgttcggaatcactgggcgtaaagggcgcgtaggcggctttgtaagtcgggggtgaaagcctgtggctcaaccacagaattgccttcgatactgcatggcttgagaccggaagaggttagtggaactgcgagtgtagaggtgaaattcgtagatattcgcaagaacaccagtggcgaaggcggctgactggtccggttctgacgctgaggcgcgaaagcgtggggagcaaacagg

SEQ ID NO: 707 - DNA, 253 bp, Balneimonas sp.
  Alphaproteobacteria; Bradyrhizobiaceae; Balneimonas
tacgaagggggctagcgctgttcggaatcactgggcgtaaagggcgcgtaggcggccgatcaagtcgggggtggaagcctgtggctcaaccacagaatggccttcgatactgtttggcttgagaccggaagaggtcagtggaactgcgagtgtagaggtgaaattcgtagatattcgcaagaacaccagtggcgaaggcggctgactggtccggttctgacgctgaggcgcgaaagcgtggggagcaaacagg

SEQ ID NO: 708 - DNA, 253 bp, Balneimonas sp.
  Alphaproteobacteria; Bradyrhizobiaceae; Balneimonas
tacgaagggggctagcgttgttcggaatcactgggcgtaaagggcgcgtaggcggcctgataagtcgggggtgaaagcctgtggctcaaccacagaattgccttcgatactgtctggcttgagaccggaagaggtaagtggaactgcgagtgtagaggtgaaattcgtagatattcgcaagaacaccagtggcgaaggcggcttactggaccggttctgacgctgaggcgcgaaagcgtggggagcaaacagg

SEQ ID NO: 709 - DNA, 253 bp, Bosea genosp.
  Alphaproteobacteria; Bradyrhizobiaceae; Bosea genosp.
tacgaagggggctagcgttgctcggaatcactgggcgtaaagggtgcgtaggcgggtttttaagtcagaggtgaaatcctggagctcaactccagaactgcctttgatactgggaatcttgagtatggaagaggtgagtggaactgcgagtgtagaggtgaaattcgtagatattcgcaagaacaccagtggcgaaggcggctcactggtccataactgacgctgaggcacgaaagcgtggggagcaaacagg

SEQ ID NO: 710 - DNA, 253 bp, Bosea genosp.
  Alphaproteobacteria; Bradyrhizobiaceae; Bosea genosp.
tacgaagggggctagcgttgctcggaatcactgggcgtaaagggtgcgtaggcgggtttctaagtcagaggtgaaatcctggagctcaactccagaactgcctttgatactggaagtcttgagtatgggagaggtgagtggaactgcgagtgtggaggtgaaattcgtagatattcgcaagaacaccagtggcgaaggcggctcactggcccattactgacgctgaggcacgaaagcgtggagagcaaacagg

SEQ ID NO: 711 - DNA, 253 bp, Bosea genosp.
  Alphaproteobacteria; Bradyrhizobiaceae; Bosea genosp.
tacgaagggggctagcgttgctcggaatcactgggcgtaaagggtgcgtaggcgggtttctaagtcagaggtgaaagcctggagctcaactccagaactgcctttgatactggaagtcttgagttcgggagaggtgagtggaactgcgagtgtaggggtgaaattcgtagatattcgcaagaacaccagtggcgaaggcggctcactggcccgatactgacgctgaggcacgaaagcgtggggagcaaacagg

SEQ ID NO: 712 - DNA, 253 bp, Bradyrhizobium sp.
  Alphaproteobacteria; Bradyrhizobiaceae; Bradyrhizobium
tacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 713 - DNA, 253 bp, Bradyrhizobium sp.
  Alphaproteobacteria; Bradyrhizobiaceae; Bradyrhizobium
tacgtagggtgcaagcgttggtcggaattactgggcgtaaagggtgcgtaggcgggtttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtgaggagcaaacagg

SEQ ID NO: 714 - DNA, 253 bp, Bradyrhizobium sp.
  Alphaproteobacteria; Bradyrhizobiaceae; Bradyrhizobium
tacgaagggggctagcgttgctcggaatcactgggcgtaaagggtgcgtaggcgggtctttaagtcagaggtgaaatcctggagctcaactccagaactgcctttgatactgagggtcttgagtatgacagaggtgagtggaactgcgagtgtagaggtgaaattcgtagatattcgcaagaacaccagtggcgaaggcggctcactgggtcattactgacgctgaggcacgaaagcgtggggagcaaacagg

SEQ ID NO: 715 - DNA, 253 bp, Ochrobactrum intermedium
  Alphaproteobacteria; Brucellaceae; Ochrobactrum intermedium
tacgaagggggctagcgttgttcggatttactgggcgtaaggcgcacgtaggcgggctaataagtcaggggtgaaatcccggggcttaaccccggaactgcctttgatactgttagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacagg

SEQ ID NO: 716 - DNA, 253 bp, Unknown
  Description of Unknown: bacterium polynucleotide
  Alphaproteobacteria; Caulobacteraceae
tacgaagggggctagcgttgctcggaattactgggcgtaaagggcgcgtaggcgggtcgttaagttgggggtgaaagcccagggctcaaccctggaattgccttcaatactggcgaccttgagtatggcagaggtgtgtggaactccgagtgtagaggtgaaattcgtagatattcggaagaacaccagtggcgaaggcgacacactgggccattactgacgctgaggcgcgaaagcgtggggagcaaacagg

SEQ ID NO: 717 - DNA, 253 bp, Unknown
  Description of Unknown: bacterium polynucleotide
  Alphaproteobacteria; Caulobacteraceae
tacgaagggggctagcgttgctcggaattactgggcgtaaagggagcgtaggcggacatttaagtcaggggtgaaatcccggggctcaacctcggaattgcctttgatactgggtgtcttgagtatgagagaggtgtgtggaactccgagtgtagaggtgaaattcgtagatattcggaagaacaccagtggcgaaggcgacacactggctcattactgacgctgaggctcgaaagcgtggggagcaaacagg

SEQ ID NO: 718 - DNA, 253 bp, Unknown
  Description of Unknown: bacterium polynucleotide
  Alphaproteobacteria; Caulobacteraceae
tacgaagggggctagcgttgctcggaattactgggcgtaaagggcgcgtaggcggacgactaagtcgggggtgaaagcccggggctcaacctcggaattgccttcgatactggtcgtcttgagtacgggagaggtgtgtggaactccgagtgtagaggtgaaattcgtagatattcggaagaacaccagtggcgaaggcgacacactggcccgttactgacgctgaggcgcgaaagcgtggggagcaaacagg

SEQ ID NO: 719 - DNA, 253 bp, Unknown
  Description of Unknown: bacterium polynucleotide
  Alphaproteobacteria; Caulobacteraceae
tacgaagggggctagcgttgctcggaattactgggcgtaaagggagcgtaggcggatagttcagtcagaggtgaaagcccagggctcaaccttggaattgcctttgatactggctgtcttgagtatgggagaggttagcggaactccgagtgtagaggtgaaattcgtagatattcggaagaacaccagtggcgaaggcggctaactggcccattactgacgctgaggctcgaaagcgtggggagcaaacagg

SEQ ID NO: 720 - DNA, 253 bp, Unknown
  Description of Unknown: bacterium polynucleotide
  Alphaproteobacteria; Caulobacteraceae
tacgaagggggctagcgttgctcggaattactgggcgtaaagggagcgtaggcggacagtttagtcagtggtgaaagcccagggctcaaccttggaatagccattgatactgattgtcttgagtatgggagaggtatgcggaactccgagtgtagaggtgaaattcgtagatattcggaagaacaccagtggcgaaggcggcatactggcccattactgacgctgaggctcgaaagcgtggggagcaaacagg

SEQ ID NO: 721 - DNA, 253 bp, Unknown
  Description of Unknown: bacterium polynucleotide
  Alphaproteobacteria; Caulobacteraceae
tacgaagggagctagcgttgctcggaattactgggcgtaaagggagcgtaggcggatcgtttagtcaggggtgaaatcccggggctcaacctcggaactgcccttgatactggcgatcttgagtatgggagaggtgtgtggaactccgagtgtagaggtgaaattcgtagatattcggaagaacaccagtggcgagggcgacacactggcccattactgacgctgaggctcgaaagcgtggggagcaaacagg

SEQ ID NO: 722 - DNA, 253 bp, Arthrospira sp.
  Alphaproteobacteria; Caulobacteraceae; Arthrospira
tacgaagggggctagcgttgctcggaattactgggcgtaaagggagcgtaggcggatagttcagtcagaggtgaaagcccagggctcaaccttggaactgcctttgatactggctatcttgagtttgggagaggtgtgtggaactccgagtgtagaggtgaaattcgtagatattcggaagaacaccagtggcgaaggcgacacactggcccaatactgacgctgaggctcgaaagcgtggggagcaaacagg

SEQ ID NO: 723 - DNA, 253 bp, Asticcacaulis biprosthecium
  Alphaproteobacteria; Caulobacteraceae; Asticcacaulis biprosthecium
tacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacagg

SEQ ID NO: 724 - DNA, 253 bp, Asticcacaulis sp.
  Alphaproteobacteria; Caulobacteraceae; Asticcacaulis
tacgaagggggctagcgttgttcggaattactgggcgtaaagggagcgtaggcgggtcgacaagttggaggtgaaagcccagggctcaaccttggaattgccttcaaaactgtcgatcttgagtatgggagaggtaagcggaactccgagtgtagaggtgaaattcgtagacattcggaagaacaccagtggcgaaggcggcttactggctcgatactgacgctgaggtgcgaaagcgtggggagcagacagg

SEQ ID NO: 725 - DNA, 253 bp, Asticcacaulis sp.
  Alphaproteobacteria; Caulobacteraceae; Asticcacaulis
tacgaagggggctagcgttgctcggaattactgggcgtaaagggagcgtaggcgggttaccaagttgggggtgaaatcccggggctcaacctcggaattgccttcaaaactgatagcctagagtatgatagaggtatgtggaattccgagtgtagaggtgaaattcgtagatattcggaggaacaccagtggcgaaggcgacatactgggtcatgactgacgctgaggctcgaaagcgtggggagcaaacagg

SEQ ID NO: 726 - DNA, 253 bp, Asticcacaulis sp.
  Alphaproteobacteria; Caulobacteraceae; Asticcacaulis
tacgaagggggctagcgttgctcggaattactgggcgtaaagggagcgtaggcgggtcgtcaagttgggggtgaaagcccagggctcaaccttggaattgccttcaaaactgacgatctagagtatggaagaggtaagtggaactccgagtgtagaggtgaaattcgtagatattcggaagaacaccagtggcgaaggcgacttactggtccatgactgacgctgaggctcgaaagcgtggggagcaaacagg

SEQ ID NO: 727 - DNA, 253 bp, Asticcacaulis sp.
  Alphaproteobacteria; Caulobacteraceae; Asticcacaulis
tacgaagggggctagcgttgctcggaattactgggcgtaaagggagcgtaggcgggttatcaagttgggggtgaaagcccggggctcaacctcggaattgccttcaaaactgataacctggagtatggaagaggtaagtggaactccgagtgtagaggtgaaattcgtagatattcgggagaacaccagtggcgaaggcgacttactggtccattactgacgctgaggctcgaaagcgtggggagcaaacagg

SEQ ID NO: 728 - DNA, 253 bp, Brevundimonas diminuta
  Alphaproteobacteria; Caulobacteraceae; Brevundimonas diminuta
tacgaagggggctagcgttgctcggaattactgggcgtaaagggcgcgtaggcggatcgttaagtcagaggtgaaatcccggagctcaacttcggaactgcctttgatactggcgatcttgagtgtgagagaggtatgtggaactccgagtgtagaggtgaaattcgtagatattcggaagaacaccagtggcgaaggcgacatactggctcattactgacgctgaggcgcgaaagcgtggggagcaaacagg

SEQ ID NO: 729 - DNA, 253 bp, Caulobacter sp.
  Alphaproteobacteria; Caulobacteraceae; Caulobacter
tacgaagggggctagcgttgctcggaattactgggcgtaaagggagcgtaggcggatagtttagtcagaggtgaaagcccagggctcaaccttggaattgcctttgatactggctatcttgagtatggaagaggtatgtggaactccgagtgtagaggtgaaattcgtagatattcggaagaacaccagtggcgaaggcgacatactggtccattactgacgctgaggctcgaaagcgtggggagcaaacagg

SEQ ID NO: 730 - DNA, 253 bp, Caulobacter sp.
  Alphaproteobacteria; Caulobacteraceae; Caulobacter
tacgaagggggctagcgttgctcggaattactgggcgtaaagggagcgtaggcggactgttaagttagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 731 - DNA, 253 bp, Mycoplana sp.
  Alphaproteobacteria; Caulobacteraceae; Mycoplana
tacgaagggggctagcgttgctcggaattactgggcgtaaagggagcgtaggcggacatttaagtcagaggtgaaatcccggagcttaacttcggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 732 - DNA, 253 bp, Mycoplana sp.
  Alphaproteobacteria; Caulobacteraceae; Mycoplana
tacgaagggggctagcgttgctcggaattactgggcgtaaagggagcgtaggcggacatttaagtcaggggtgaaatcccagagctcaactctggaactgccttcgatactggatgtcttgagtatgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 733 - DNA, 253 bp, Phenylobacterium sp.
  Alphaproteobacteria; Caulobacteraceae; Phenylobacterium
tacgaagggggctagcgttgctcggaattactgggcgtaaagggcgcgtaggcggacagtttagtcagaggtgaaagcccagggctcaaccttggaattgcctttgatactggctgtcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacagg

SEQ ID NO: 734 - DNA, 253 bp, Phenylobacterium sp.
  Alphaproteobacteria; Caulobacteraceae; Phenylobacterium
tacgaagggggctagcgttgctcggaattgctgggcgtaaagggcgcgtaggcggatatctaagttgggggtgaaatcccggggctcaacctcggaattgccttcaaaactggatatcttgagttcgggagaggtgagtggaactccgagtgtagaggtgaaattcgtagatattcggaagaacaccagtggcgaaggcgactcactggcccgatactgacgctgaggcgcgaaagcgtggggagcaaacagg

SEQ ID NO: 735 - DNA, 253 bp, Phenylobacterium sp.
  Alphaproteobacteria; Caulobacteraceae; Phenylobacterium
tacgaagggggctagcgttgctcggaattactgggcgtaaagggagcgtaggcggatagtttagtcagaggtgaaagcccagggctcaaccttggaactgcctttgatactggctatcttgagtatgggagaggtgagtggaactccgagtgtagaggtgaaattcgtagatattcggaagaacaccagtggcgaaggcgactcactggcccattactgacactgaggtgcgaaagcgtggggagcaaacagg

SEQ ID NO: 736 - DNA, 253 bp, Phenylobacterium sp.
  Alphaproteobacteria; Caulobacteraceae; Phenylobacterium
tacgaagggggctagcgttgctcggaatcactgggcataaagggcgcgtaggcggacagtttagttgggggtgaaagcccggggctcaacctcggaattgccttcaatactggctgtcttgagtacgggagaggtgtgtggaactccgagtgtagaggtgaaatccgtagatattcggaagaacaccagtggcgaaggcggctcactggcccgatactgacgctgaggcacgaaagcgtggggatcaaacagg

SEQ ID NO: 737 - DNA, 253 bp, Phenylobacterium sp.
  Alphaproteobacteria; Caulobacteraceae; Phenylobacterium
gacggggggggcaagcgttgtccggatttactgggcgtaaagggcgcgtaggcggatatctaagtcgggggtgaaagcccggggctcaacctcggaattgccttcgatactggatatcttgagttcgggagaggtgagtggaatgccgagtgtagaggtgaaattcgtagatattcggcggagcaccagtggcgaaggcgactcactggcccgatactgacgctgaggcgcgaaagcgtggggagcaaacagg

SEQ ID NO: 738 - DNA, 253 bp, Phenylobacterium sp.
  Alphaproteobacteria; Caulobacteraceae; Phenylobacterium
tacgaagggggctagcgttgctcggaattactgggcgtaaagggcgcgtaggcggatgtttaagtcagcggtgaaagcccagggctcaaccttggaactgccattgatactggacatcttgagtacgggagaggtgagtggaactccgagtgtagaggtgaaattcgtagatattcggaagaacaccagtggcgaaggcgactcactggcccgttactgacgctgaggcgcgaaagcgtggggagcaaacagg

SEQ ID NO: 739 - DNA, 253 bp, Unknown
  Description of Unknown: bacterium polynucleotide
  Alphaproteobacteria; Erythrobacteraceae
tacggagggagctagcgttgttcggatatactgggcgtaaagcgcacgtaggcggcgccgtaagtcaggggtgaaatcccggagctcaactccggaactgcccttgaaactgcagtgctagaatcctggagaggcgagtggaattccgagtgtagaggtgaaattcgtagatattcggaagaacaccagtggcgaaggcgactcgctggacaggtattgacgctgaggtgcgaaagcgtggggagcaaacagg

SEQ ID NO: 740 - DNA, 253 bp, Unknown
  Description of Unknown: bacterium polynucleotide
  Alphaproteobacteria; Erythrobacteraceae
tacggagggagctagcgttgttcggaaatactgggcgtaaagcgcacgtaggcggcgcagcaagtcaggggtgaaatcccggggctcaaccccggaactgcctctgaaactgcagtgctagaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 741 - DNA, 253 bp, Unknown
  Description of Unknown: bacterium polynucleotide
  Alphaproteobacteria; Erythrobacteraceae
tacggagggagctagcgttgttcggtattactgggcgtaaagcgcacgtaggcggctcagcaagtcaggggtgaaatcccggggctcaaccccggaactgcccttgaaactgctaggctagaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 742 - DNA, 253 bp, Unknown
  Description of Unknown: bacterium polynucleotide
  Alphaproteobacteria; Erythrobacteraceae
tacggagggagctagcgttgttcggaattactgggcgtaaagcgcacgtaggcggcgatccaagtcagaggtgaaatcccggggctcaaccccggaactgcctttgaaactagattgctagaatcctggagaggtgagtggaattccgagtgtagaggtgaaattcgtagatattcggaagaacaccagtggcgaaggcgactcactggacaggtattgacgctgaggtgcgaaagcgtggggagcaaacagg

SEQ ID NO: 743 - DNA, 253 bp, Unknown
  Description of Unknown: bacterium polynucleotide
  Alphaproteobacteria; Erythrobacteraceae
tacggagggggctagcgttgttcggaaatactgggcgtaaagcgaacgtaggcggcttggcaagtcaggggtgaaatcccagtgctcaacactggaactgcctttgaaactgccaggcttgaatcctggagaggcgagtggaattccgagtgtagaggtgaaattcgtagatattcggaagaacaccagtggcgaaggcgactcgctggacaggtattgacgctgaggttcgaaagcgtggggagcaaacagg

SEQ ID NO: 744 - DNA, 253 bp, Erythrobacter sp.
  Alphaproteobacteria; Erythrobacteraceae; Erythrobacter
tacggagggagctagcgttgttcggaattactgggcgtaaagcgcacgtaggcggctctttaagtcaggggtgaaatcccggggcccaaccccggaactgcccttgaaactgcagagctagaatactggagaggtgagtggaattccgagtgtagaggagaaattcgtagatgttcggaagaacaccagtggcgaaggcgactcactggacagtcattgacgctgaggtgcgaaagcgtggggagcaaacagg

SEQ ID NO: 745 - DNA, 253 bp, Erythromicrobium sp.
  Alphaproteobacteria; Erythrobacteraceae; Erythromicrobium
tacggagggagctagcgttgttcggaattactgggcgtaaagcgcacgtaggcggctttttaagtcaggggtgaaatcccggggctcaaccccggaactgcccttgaaactggaaagctagaatctgggagagggatgtggaattcctggtgtagaggtgaaattcgtagagatcaggaggaacactcgtggcgaaggcgacatcctggaccaagattgacgctgaggcgcgaaagcgtggggagcaaacagg

SEQ ID NO: 746 - DNA, 253 bp, Unknown
  Description of Unknown: bacterium polynucleotide
  Alphaproteobacteria; Hyphomicrobiaceae
tacgaagggggctagcgttgttcggaatcactgggcgtaaagcgcacgtaggcggactttcaagtcaggggtgaaatcccggggctcaacctcggaattgcctttgatactgtaggtctcgagtccggaagaggtgggtggaattcctagtgtagaggtgaaattcgtagatattaggaagaacaccggtggcgaaggcggcccactggtccggtactgacgctgaggtgcgaaagcgtggggagcaaacagg

SEQ ID NO: 747 - DNA, 253 bp, Devosia sp.
  Alphaproteobacteria; Hyphomicrobiaceae; Devosia
tacgaagggggctagcgttgttcggatttactgggcgtaaagcgcacgtaggcggattggtcagttaggggtgaaatcccagagctcaactctggaactgcctttaatactgccagtctagagtccggaagaggtaagtggaactcctagtgtagaggtggaattcgtagatattaggaagaacaccagtggcgaaggcggcttactggtccggtactgacgctgaggtgcgaaagcgtggggagcaaacagg

SEQ ID NO: 748 - DNA, 253 bp, Devosia sp.
  Alphaproteobacteria; Hyphomicrobiaceae; Devosia
tacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 749 - DNA, 253 bp, Devosia sp.
  Alphaproteobacteria; Hyphomicrobiaceae; Devosia
tacgaagggggctagcgttgttcggatttactgggcataaagcgcacgtaggcggattgttaggtcaggggtgaaatcctggagctcaactccagaactgcctttgatactggcaatctcgagtccggaagaggtaagtggaactcctagtgtagaggtggaattcgtagatattaggtagaacaccagtggcgaaggcggcttactggtccggtactgacgctgaggtgcgaaagcgtggggagcaaacagg

SEQ ID NO: 750 - DNA, 253 bp, Devosia sp.
  Alphaproteobacteria; Hyphomicrobiaceae; Devosia
tacgaagggggctagcgttgttcggatttactgggcgtaaagcgcacgtaggcggtttgttaagtcaggggtgaaatcccggagctcaactccggaactgcctttgatactggcaagctagagtccggaagaggtaagtggaactcctagtgtagaggtggaattcgtagatattaggaggaacaccagtggcgaaggcggcttactggtccggaactgacgctgaggtgcgaaagcgtggggagcaaacagg

SEQ ID NO: 751 - DNA, 253 bp, Devosia sp.
  Alphaproteobacteria; Hyphomicrobiaceae; Devosia
tacgaagggggctagcgtcgttcggatttactgggagtaaagcgcacgtaggcggattgttaagtcaggggtgaaatcctggagctcaactccagaactgcctttgatactggcaatctcgagcccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 752 - DNA, 253 bp, Devosia sp.
  Alphaproteobacteria; Hyphomicrobiaceae; Devosia
tacgaggggggctagcgttgttcggatttactgggcgtaaagcgcacgtaggcggattggtcagttagaggtgaaatcccgaagctcaacttcggaactgcctttaatactgccaatctagagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 753 - DNA, 253 bp, Devosia sp.
  Alphaproteobacteria; Hyphomicrobiaceae; Devosia
tacgaagggggctagcgttgttcggatttactgggcgtaaagcgcacgtaggcggattggtcagttaggggtgaaatcctggagctcaactccagaactgcctttaatactgccaatctcgagtccggaagaggtaagtggaactcctagtgtagaggtggaattcgtagatattaggaagaacaccagtggcgaaggcggcttactgggccggtactgacgctgaggtgcgaaagcgtagggagcaaacagg

SEQ ID NO: 754 - DNA, 253 bp, Devosia sp.
  Alphaproteobacteria; Hyphomicrobiaceae; Devosia
tacgaagggggctagcgttgttcggatttactgggcgtaaagcgcacgtaggcggattgttaagtcaggggtgaaatcctggagctcaactctagaactgcctttgatactggcaatctagagtccggaagaggtgagtggaactcctagtgtagaggtggaattcgtagatattaggaagaacaccagtggcgaaggcggctcactggtccggtactgacgctgaggcacgaaagcgcggggatcaaacagg

SEQ ID NO: 755 - DNA, 253 bp, Devosia sp.
  Alphaproteobacteria; Hyphomicrobiaceae; Devosia
tacgaagggggctagcgttgttcggatttgctgggcgtaaagcgcacgtaggcggattgttaagtcgggggtgaaatcctggagctcaactccagaactgccttcgatactggcaatctcgagtccggaagaggtaagtggaactcccagtgtagaggtggaatacgtagatattaggaagaacaccagtggcgaaggcggcttactggtccggtactgacgctgaggtgcgaaagcgtggggagcaaacagg

SEQ ID NO: 756 - DNA, 253 bp, Devosia sp.
  Alphaproteobacteria; Hyphomicrobiaceae; Devosia
tacgaagggggctagcgttgttcggatttactgggcgtaaagcgcacgtaggcggattgttaagttaggggtgaaatcctggagctcaactccagaactgcctctaatactggcaatctagagtccggaagaggtgagtggaactcctagtgtagaggtggaattcgcagatattaggaagaacgccagtggcgaaggcggctcactggtccggcactgacgctgaggtgcgaaagcgtggggagcaaacagg

SEQ ID NO: 757 - DNA, 253 bp, Devosia sp.
  Alphaproteobacteria; Hyphomicrobiaceae; Devosia
tacgaagggggctagcgttgttcggatttactgggcgtaaagcgcacgtaggcggtttgttaagtgagaggtgaaatcccagagctcaactctggaactgcctttcatactggcaagctagagtccggaagaggtaagtggaacacctagtgtagaggtggaattcgtagatattaggaagaacaccagtggcgaaggcgacttactggtccggaactgacgctgaggtgcgaaagcgtggggagcaaacagg

SEQ ID NO: 758 - DNA, 253 bp, Devosia sp.
  Alphaproteobacteria; Hyphomicrobiaceae; Devosia
tacgaagggggctagcgttgttcggatctactgggcgtaaagcgcacgtaggcggatcgatcagtcaggggtgaaaccctggagctcaactccagaactgcctttgatactgtcgatctcgagtccggaagaggtgagtggaactcctagtgtagaggtggaattcgtagatattaggaagaacaccagtggcgaaggcggctcactggtccggaactgacgctgaggtgcgaaagcgtggggagcaaacagg

SEQ ID NO: 759 - DNA, 253 bp, Devosia sp.
  Alphaproteobacteria; Hyphomicrobiaceae; Devosia
tacgaagggggctagcgttgttcggaattactgggcgtaaagcgcacgtaggcggatatttaagtcaggggtgaaatcccggagctcaactccggaactgcctttgatactggatatctagagaccgagagaggtaagtggaactcctagtgtagaggtggaattcgtagatattaggaagaacaccagtggcgaaggcggcttactggctcggaactgacgctgaggtgcgaaagcgtggggagcaaacagg

SEQ ID NO: 760 - DNA, 253 bp, Devosia sp.
  Alphaproteobacteria; Hyphomicrobiaceae; Devosia
tacgaagggggcaagtgttgttcggatttactgggcgtaaagcgcacgtaggcggatcgttaagtcgggggtgaaatcccggggctcaaccccggaactgccttcgatactggcgatcttgagcccggaagaggtgagtggaactcctagtgtagaggtggaattcgtagatattaggaagaacaccagtggcgaaggcggctcactggtccggtactgacgctgaggtgcggaagcgtggggagcaaacagg

SEQ ID NO: 761 - DNA, 253 bp, Devosia sp.
  Alphaproteobacteria; Hyphomicrobiaceae; Devosia
tacgaagggggctagcgttgttcggatttactgggcgtaaagcgcacgtaggcggattggtaagttaggggtgaaatcctggagctcaactccagaactgcctttaatactgccagtctagggtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 762 - DNA, 253 bp, Devosia sp.
  Alphaproteobacteria; Hyphomicrobiaceae; Devosia
tacgaagggggctagcgttgttcggatttactgggcgtaaagcgcacgtaggcggatcgttaagtgaggggtgaaatcccagggctcaaccctggaactgcctttcatactggcgatctcgagtccggaagaggtgagtggaactcctagtgtagaggtggaattcgtagatattaggaagaacaccagtggcgaaggcgactcactggacatgtattgacgctgaggtgcgaaagcgtggggagcaaacagg

SEQ ID NO: 763 - DNA, 253 bp, Hyphomicrobium sp.
  Alphaproteobacteria; Hyphomicrobiaceae; Hyphomicrobium
tacgaaggggactagcgttgttcggaattactgggcgtaaagcgtacgtaggcggatttgttagtcaggggtgaaatcccggggctcaacctcggaactgcctttgatactgcaaatctcgagtccgatagaggtgggtggaattcctagtgtagaggtgaaattcgtagatattaggaagaacaccggtggcgaaggcggcccactggatcggtactgacgctgaggtgcgaaagcgtggggagcaaacagg

SEQ ID NO: 764 - DNA, 253 bp, Hyphomicrobium sp.
  Alphaproteobacteria; Hyphomicrobiaceae; Hyphomicrobium
tacgaagggggctagcgttgttcggaattactgggcgtaaagcgcacgtaggcggatttgtaagttaggggtgaaatcccggggctcaacctcggaactgcctttgatactgcaagtctcgagtccggaagaggtgagtggaattcctagtgtagaggtgaaatccgtagatattaggaagaacaccagtggcgaaggcggctcactggtccggtactgacgctgaggtgcgaaagcgtggggagcaaacagg

SEQ ID NO: 765 - DNA, 253 bp, Parvibaculum sp.
  Alphaproteobacteria; Hyphomicrobiaceae; Parvibaculum
tacggagggggctagcgttgttcggaattactgggcgtaaagcgcacgtaggcggctatccaagttgggggtgaaatccctgggcttaacccaggaactgccttcaaaactggatggctagagtccgagagaggtgagtggaatttccagtgtagaggtgaaattcgtagatattggaaagaacaccagtggcgaaggcggctcactggctcggtactgacgctgaggtgcgacagcgtggggagcaaacagg

SEQ ID NO: 766 - DNA, 253 bp, Pedomicrobium sp.
  Alphaproteobacteria; Hyphomicrobiaceae; Pedomicrobium
tacgaagggggctagcgttgttcggaatcactgggcgtaaagcgcacgtaggcggatgtgccagtcaggggtgaaatcccggagctcaactccggaactgcctctgatacagcacatcttgagtccggaagaggtgggtggaattcctagtgtagaggtgaaattcgtagatattaggaagaacaccggtggcgaaggcagcccactggtccggtactgacgctgaggtgcgaaagcgtggggagcaaacagg

SEQ ID NO: 767 - DNA, 253 bp, Rhodoplanes sp.
  Alphaproteobacteria; Hyphomicrobiaceae; Rhodoplanes
tacgaagggggctagcgttgctcggaattactgggcgtaaagcgcacgtaggcggaccgataagtcgggggtgaaatcctggagctcaactccagaactgccttcgaaactgccggtcttgagttcgggagaggtgagtggaactgcgagtgtagaggtgaaattcgtagatattcgcaagaacaccagtggcgaaggcggctcactggcccgatactgacgctgaggcgcgaaagcgtggggagcaaacagg

SEQ ID NO: 768 - DNA, 253 bp, Rhodoplanes sp.
  Alphaproteobacteria; Hyphomicrobiaceae; Rhodoplanes
tacgaagggggctagcgttgctcggaaccactgggcgtaaagcgcacgtaggcggattgttaagtcaggggtgaaatcctggagctcaactccagaactgcctttggtactggcgatcttgagttcgggagaggtgagtggaactgcgagtgtagaggtgaaattcgtagatattcgcaagaacaccagtggcgaaggcggctcactggcccgatactgacgctgaggtgcgaaagcgtggggatcaaacagg

SEQ ID NO: 769 - DNA, 253 bp, Rhodoplanes sp.
  Alphaproteobacteria; Hyphomicrobiaceae; Rhodoplanes
tacgaagggggctagcgttgctcggaattactgggcgtaaagcgcacgtaggcggctttctaagtcgggggtgaaatcctggagctcaactccagaactgccttcgatactggagagctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacagg

SEQ ID NO: 770 - DNA, 253 bp, Rhodoplanes sp.
  Alphaproteobacteria; Hyphomicrobiaceae; Rhodoplanes
tacgaagggggttagcgttgctcggaattactgggcgtaaagcgcacgtaggcggctttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggtccggtactgacgctgaggtgcgaaagcgtggggagcaaacagg

SEQ ID NO: 771 - DNA, 253 bp, Rhodoplanes sp.
  Alphaproteobacteria; Hyphomicrobiaceae; Rhodoplanes
tacgaagggggctagcgttgctcggaattactgggcgtaaagcgcacgtaggcgggtctttaagtcgggggtgaaatcctggagctcaactccagaactgccttcgaaactgaagatcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacagg

SEQ ID NO: 772 - DNA, 253 bp, Rhodoplanes sp.
  Alphaproteobacteria; Hyphomicrobiaceae; Rhodoplanes
tacgaagggggctagcgttgctcggaatcactgggcgtaaagcgcacgtaggcggctttttaagtcaggggtggaatcctggagctcaactccagaactgcctttgatactgagaagcttgagtccgggagaggtgagtggaactgcgagtgtagaggtgaaattcgtagatattcgcaagaacaccagtggcgaaggcggctcactggcccggtactgacgctgaggtgcgagagcgtggggagcaaacagg

SEQ ID NO: 773 - DNA, 253 bp, Rhodoplanes sp.
  Alphaproteobacteria; Hyphomicrobiaceae; Rhodoplanes
tacgaagggggctggcgttgctcggaatcactgggcgtaaagcgcacgtaggcggatctttaagtcaggggtgaaatcctggagctcaactccagaactgcctttgatactggggatctcgagttcgggagaggtgagtggaactgcgagtgtagaggtgaaattcgtagatattcgcaagaacaccagtggcgaaggcggctcactggcccgatactgacgctgaggtgcgaaagcgtggggagcaaacagg

SEQ ID NO: 774 - DNA, 253 bp, Rhodoplanes sp.
  Alphaproteobacteria; Hyphomicrobiaceae; Rhodoplanes
tacgaagggggctagcgttgctcggaatcactgggcgtaaagcgcacgtaggcggctttctaagtcaggggtgaaatcctggagctcaactccagaactgcctttgatactgggaagctcgagtccggaagaggtgagtggaactccgagtgtagaggtgaaattcgtagatattcggaagaacaccagtggcgaaggcggctcactggtccggtactgacgctgaggtgcgaaagcgtggggagcaaacagg

SEQ ID NO: 775 - DNA, 253 bp, Rhodoplanes sp.
  Alphaproteobacteria; Hyphomicrobiaceae; Rhodoplanes
tacgaagggggctagcgttgctcggaatcactgggcgtaaagcgcacgtaggcggactcttaagtcaggggtgaaatcctggagctcaactccagaactgcctttgatactgggagccttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacagg

SEQ ID NO: 776 - DNA, 254 bp, Rhodoplanes sp.
  Alphaproteobacteria; Hyphomicrobiaceae; Rhodoplanes
tacgaagggggctagcgttgctcggaatcactgggcgtaaagcgcacgtaggcgggctcttaagtcggtggtgaaatcctggagctcaactccagaactgcctccgatactgagagtcttcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacagg

SEQ ID NO: 777 - DNA, 253 bp, Rhodoplanes sp.
  Alphaproteobacteria; Hyphomicrobiaceae; Rhodoplanes
tacgaagggggctagcgttgctcggaatcactgggcgtaaagcgcacgtaggcggatctttaagtcgggggtgaaatcccggagctcaactccggaactgccttcgatactgaggatctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacagg

SEQ ID NO: 778 - DNA, 253 bp, Rhodoplanes sp.
  Alphaproteobacteria; Hyphomicrobiaceae; Rhodoplanes
tacgaagggggctagcgttgctcggaattactgggcgtaaagcgtacgtaggcggtcttttaagtcgggggtgaaatcctggagctcaactccagaactgccttcgatactggaagactcgagtccgggagaggtgagtggaactgcgagtgtagaggtgaaattcgtagatattcgcaagaacaccagtggcgaaggcggctcactggcccggtactgacgctgaggtgcaaaagcgtggggagcaaacagg

SEQ ID NO: 779 - DNA, 253 bp, Rhodoplanes sp.
  Alphaproteobacteria; Hyphomicrobiaceae; Rhodoplanes
tacgaagggggctagcgttgctcggaattactgggcgtgaagcgcacgtaggcggcttcttaagtcggaggtgaaatcctggagctcaactccagaactgccttcgatactgggaagcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacagg

SEQ ID NO: 780 - DNA, 253 bp, Unknown
  Description of Unknown: bacterium polynucleotide
  Alphaproteobacteria; Hyphomonadaceae
tacgaagggggctagcgttgttcggaattactgggcgtaaagcgcacgtaggcgggtttgtaagtagggggtgaaatccctgggctcaacccaggaactgccttctagactgcaagcctggaggtcaggagaggcgagtggaataccgagtgtagaggtgaaattcgtagatattcggtggaacaccagtggcgaaggcgactcgctggactgatactgacgctgaggtgcgaaagcgtggggagcaaacagg

SEQ ID NO: 781 - DNA, 253 bp, Unknown
  Description of Unknown: bacterium polynucleotide
  Alphaproteobacteria; Hyphomonadaceae
tacgaagggggctagcgttgttcgggtttactgggcgtaaggcgcgtgtaggcgggctggaaagttgggggtgaaatcccgaggctcaacctcggaactgcctccaaaacttccagcctggactcaagtagaggcaagtggaattgcgagtgtagaggtgaaattcgtagatattcgcaggaacaccagtggcgaaggcgacttgctggacttgtagtgacgctgagacgcgaaagcgtggggagcaaacagg

SEQ ID NO: 782 - DNA, 253 bp, Unknown
  Description of Unknown: bacterium polynucleotide
  Alphaproteobacteria; Methylobacteriaceae
tacgaagggggctagcgttgctcggaatcactgggcgtaaagggcgcgtaggcggctgatttagtcgagggtgaaagcccgtggctcaaccacggaatggccttcgatactgattggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 783 - DNA, 253 bp, Unknown
  Description of Unknown: bacterium polynucleotide
  Alphaproteobacteria; Methylobacteriaceae
tacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggatctgacgctgaggcgcgaaagcgtggggagcaaacagg

SEQ ID NO: 784 - DNA, 253 bp, Unknown
  Description of Unknown: bacterium polynucleotide
  Alphaproteobacteria; Methylobacteriaceae
tacgaagggggctagcgctgctcggaatcactgggcgtaaagggcgcgtaggcggctttttaagtcgggggtgaaagcctgtggctcaaccacagaattgccttcgatactggaaagcttgagaccggaagaggacagcggaactgcgagtgtagaggtgaaattcgtagatattcgcaagaacaccagtggcgaaggcggctgtctggtccggttctggcgctgaggcgcgaaagcgtggggagcaaacagg

SEQ ID NO: 785 - DNA, 253 bp, Methylobacterium adhaesivum
  Alphaproteobacteria; Methylobacteriaceae; Methylobacterium adhaesivum
tacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaacactgacgctgaggcgcgaaagcgtggggagcaaacagg

SEQ ID NO: 786 - DNA, 253 bp, Methylobacterium adhaesivum
  Alphaproteobacteria; Methylobacteriaceae; Methylobacterium adhaesivum
tacgaagggggctagcgttgctcggaatcactgggcgtaaagggcgcgtaggcggccattcaagtcgggggtgaaagcctgtggctcaaccacagaattgccttcgatactgtttggcttgagtatggcagaggttagtggaactgcgagtgtagaggtgaaattcgtagatattcgcaagaacaccagtggcgaaggcggctgactgggccattactgacgctgaggcgcgaaagcgtggggagcaaacagg

SEQ ID NO: 787 - DNA, 253 bp, Methylobacterium organophilum
  Alphaproteobacteria; Methylobacteriaceae; Methylobacterium organophilum
tacgaagggggctagcgttgctcggaatcactgggcgtaaagggcgcgtaggcggtcttttaagtcgggggtgaaagcctgtggctcaaccacagaattgccttcgatactgggagacttgagttcggaagaggttggtggaactgcgagtgtagaggtgaaattcgtagatattcgcaagaacaccggtggcgaaggcggccaactggtccgacactgacgctgaggcgcgaaagcgtggggagcaaacagg

SEQ ID NO: 788 - DNA, 253 bp, Unknown
  Description of Unknown: bacterium polynucleotide
  Alphaproteobacteria; Methylocystaceae
tacgaagggggctagcgttgttcggaattactgggcgtaaagcgcgtgtaggcgggtctttaagtcaggggtgaaatgccaaggctcaaccttggaactgcctttgatactggagatcttgagtccgggagaggtgagtggaattgcgagtgtagaggtgaaattcgtagatattcgcaagaacaccagtggcgaaggcggctcactggcccggaactgacgctgatacgcgaaagcgtggggagcaaacagg

SEQ ID NO: 789 - DNA, 253 bp, Unknown
  Description of Unknown: bacterium polynucleotide
  Alphaproteobacteria; Methylocystaceae
tacgaagggggctagcgttgttcggaatcactgggcgtaaagggtgcgtaggcgggatcttaagtcaggggtgaaatcccgaggctcaacctcggaactgcctttgatactggggtccttgagtccggaagaggtgagtggaactgcgagtgtagaggtgaaattcgtagatattcgcaagaacaccggtggcgaaggcggctcactggtccggaactgacgctgaggcacgacagcgtggggagcaaacagg

SEQ ID NO: 790 - DNA, 253 bp, Unknown
  Description of Unknown: bacterium polynucleotide
  Alphaproteobacteria; Methylocystaceae
tacgaagggggctagcgttgttcggaattactgggcataaagcgcgtgtaggcgggcgtttaagtcaggggtgaaatgccaaggctcaaccttggaactgcctttgatactgaatgtcttgagtccgggagaggtgagtggaactgcgagtgtagaggtgaaattcgtagatattcgcaagaacaccagtggcgaaggcggctcactggcccggaactgacgctgagacgcgaaagcgtggggagcaaacagg

SEQ ID NO: 791 - DNA, 253 bp, Unknown
  Description of Unknown: bacterium polynucleotide
  Alphaproteobacteria; Methylocystaceae
tacggagggggctagcgttgttcggaatcactgtgcgtaaagggtgcgcaggcgggatcttaagtcaggggtgaaatcccgaggctcaacctcggaactgcccttgatactggggttcttgagtccggaagaggtgggtggaactgcgagtgtagaggtgaaattcgtagatattcgcaagaacaccggtggcgaaggcggcccactggtccgcaactgacgctgaggcacgacagcgtggggagcaaacagg

SEQ ID NO: 792 - DNA, 253 bp, Unknown
  Description of Unknown: bacterium polynucleotide
  Alphaproteobacteria; Methylocystaceae
tacgaagggggctagcgttgttcggaatcactgggcgtaaagggtgcgcaggcgggcatttaagtcaggggtgaaatcccgaggctcaacctcggaacggcctttgatactggatgtcttgagtccggaagaggtgagtggaactgcgagtgtagaggtgaaattcgtagatattcgcaagaacaccggtggcgaaggcggctcactggtccggaactgacgctgaggcacgacagcgtggggagcaaacagg

SEQ ID NO: 793 - DNA, 253 bp, Unknown
  Description of Unknown: bacterium polynucleotide
  Alphaproteobacteria; Methylocystaceae
tacgaagggggctagcgttgttcggaattactgggcgtaaagcgcacgtaggcggatctttaagtcagaggtgaaatcccaaggctcaaccttggaactgcctttgatactggggatcttgagtccggaagatgtgagtggaactgcgagtgtagaggtgaaattcgtagatattcgcaagaacaccagtggcgaaggcggctcactggtccggtactgacgctgaggtgcgaaagcgtggggagcaaacagg

SEQ ID NO: 794 - DNA, 253 bp, Unknown
  Description of Unknown: bacterium polynucleotide
  Alphaproteobacteria; Methylocystaceae
tacgaagggggctagcgttgttcggaatcactgggcgtaaagggtgcgcaggcggatctttaagtcaggggtgaaaggccggggctcaacctcggaacggcctttgatactggggatctcgagtccggaagaggtgggtggaactgcgagtgtagaggtgaaattcgtagatattcgcaagaacaccggtggcgaaggcggcccactggtccggaactgacgctcatgcacgacagcgtggggagcaaacagg

SEQ ID NO: 795 - DNA, 253 bp, Unknown
  Description of Unknown: bacterium polynucleotide
  Alphaproteobacteria; Methylocystaceae
tacgatgggggctggcgttgttcggattaactgggcgtaaagggtgcgtaggcgggcaattaagtcaggggtgaaatcccaaggctcaaccttggaactgcctttgatactggttgtcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacagg

SEQ ID NO: 796 - DNA, 253 bp, Aminobacter sp.
  Alphaproteobacteria; Phyllobacteriaceae; Aminobacter
tacgaagggggctagcgttgttcggaattactgggcgtaaagcgcacgtaggcggattgttaagttaggggtgaaatcccggggctcaaccccggaactgcctttaatactggcaatctcgagtccgagagaggtgggtggaattccgagtgtagaggtgaaattcgtagatattcggaggaacaccaatggcgaaggcggctcactggctcggtactgacgctgaggtgcgaaagcgtggggagcaaacagg

SEQ ID NO: 797 - DNA, 253 bp, Mesorhizobium sp.
  Alphaproteobacteria; Phyllobacteriaceae; Mesorhizobium
tacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacagg

SEQ ID NO: 798 - DNA, 252 bp, Mesorhizobium sp.
  Alphaproteobacteria; Phyllobacteriaceae; Mesorhizobium
tacagagggggcaagcgttattcggaattactgggcgtaaagcgcacgtaggcggactattaagtcaggggtgaatcccggggctcaaccccggaactgcctttgatactggtagtctcgagtccggaagaggtgagtggaattccgagtgtagaggtgaaattcgtagatattcggaggaacaccagtggcgaaggcggctcactggtccggtactgacgctgaggtgcgaaagcgtggggagcaaacagg

SEQ ID NO: 799 - DNA, 253 bp, Mesorhizobium sp.
  Alphaproteobacteria; Phyllobacteriaceae; Mesorhizobium
tacgaagggggctagcgttgttcggaattactgggcataaagcgcacgtaggcggactattaagtcaggggtgaaatcccggggctcaaccccggaactgcctttgatactggtagtctcgagtccgagagaggtgagtggaattccgagtgtagaggtgaaattcgtagatattcggaggaacaccagtggcgaaggcggctcactggctcggtactgacgcggaggtgcgaaagcgtggggagcaaacagg

SEQ ID NO: 800 - DNA, 253 bp, Thermovum composti
  Alphaproteobacteria; Phyllobacteriaceae; Thermovum composti
tacgaagggggctagcgttgttcggaattactgggcgtaaagggcgcgtaggcggactgttaagtcaggggtgaaatcccggggctcaaccccggaactgcctttgatactggcggtcttgagttcgggagaggtgagtggaattccgagagtagaggtgaaattcgtagatattcggaggaacaccagtggcgaaggcggctcactggcccgatactgacgctgaggtgcgaaagcgtggggagcaaacagg

SEQ ID NO: 801 - DNA, 253 bp, Unknown
  Description of Unknown: bacterium polynucleotide
  Alphaproteobacteria; Rhizobiaceae
tacgaagggggctagcgttgctcggaattactgggcgtaaagcgcacgtaggcggacatttaagtcaggggtgaaatcccgcagctcaactgcggaactgccttcgatactgggtgtctagagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 802 - DNA, 253 bp, Unknown
  Description of Unknown: bacterium polynucleotide
  Alphaproteobacteria; Rhizobiaceae
tacggaggatccaagcgttgtccggaattactgggcgtaaagcgcacgtaggcggatcgatcagtcaggggtgaaatcccgcagctcaactgcggaactgcctttgatactgtcggtctagagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 803 - DNA, 253 bp, Agrobacterium sp.
  Alphaproteobacteria; Rhizobiaceae; Agrobacterium
tacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 804 - DNA, 253 bp, Agrobacterium sp.
  Alphaproteobacteria; Rhizobiaceae; Agrobacterium
tacgaagggggctggcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggagcaccagtggcgaaggcggcttactggtccattactgacgctgaggtgcgaaagcgtggggagcaaacagg

SEQ ID NO: 805 - DNA, 253 bp, Agrobacterium sp.
  Alphaproteobacteria; Rhizobiaceae; Agrobacterium
tacgaagggggctagcgttgttcggatttactgggcgtaaagcgcacgtaggcggacacttaagtcaggggtgaaatcccagagctcaactctggaactgcctttgatactgggtgtttggagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 806 - DNA, 253 bp, Agrobacterium sp.
  Alphaproteobacteria; Rhizobiaceae; Agrobacterium
tacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaataccagtggcgaaggcggcttgctgggtctagactgacactcagacgcgaaagcatggggagcgaacggg

SEQ ID NO: 807 - DNA, 253 bp, Agrobacterium sp.
  Alphaproteobacteria; Rhizobiaceae; Agrobacterium
tacggagggggctagcgttgttcggaattactgggcgtaaagcgcacgtaggcggatatttaagtcaggggtgaaatcccgcagctcaactgcggaactgcctttgatactgggtatcttgagtatggaagaggttagtggaattgcgagtgtagaggtgaaattcgtagatattcgcaggaacaccagtggcgaaggcggctaactggtccataactgacgctgaggtgcgaaagcgtggggagcaaacagg

SEQ ID NO: 808 - DNA, 253 bp, Kaistia sp.
  Alphaproteobacteria; Rhizobiaceae; Kaistia
tacgaagggggcaagcgttgttcggatttactgggcgtaaagcgtacgtaggcggatcattaagtcaggggtgaaatcccgaggctcaacctcggaactgcctttgatactggtgatcttgagtccgggagaggtgagtggaactcctagtgtagaggtgaaattcgtagatattaggaagaacaccagtggcgaaggcggctcactggcccggaactgacgctgaggtacgaaagcgtggggagcaaacagg

SEQ ID NO: 809 - DNA, 252 bp, Rhizobium sp.
  Alphaproteobacteria; Rhizobiaceae; Rhizobium
tacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacttcaaaggagaaggcgaccaccgggaccaacactgacgctgaggtgcgaaagcgtggtagcaaacagg

SEQ ID NO: 810 - DNA, 253 bp, Unknown
  Description of Unknown: bacterium polynucleotide
  Alphaproteobacteria; Rhodobacteraceae
tacggagggggttagcgttgttcggaatgactgggcgtaaagcgcgcgtaggcggaccagaaagttgggggtgaaatcccggggctcaacctcggaactgccttcaagactattggtctggagttcgagagaggtgagtggatttccgagtgtagaggtgaaattcgtagatattcggaggaacaccagtggcgaaggcggctcactggctcgatactgacgctgaggtgcgaaagcgtggggagcaaacagg

SEQ ID NO: 811 - DNA, 253 bp, Unknown
  Description of Unknown: bacterium polynucleotide
  Alphaproteobacteria; Rhodobacteraceae
tacggagggggctagcgttgttcggaatcactgggcgtaaagcgcgcgtaggcggaccagcaagtcaggggtgaaagcccggggctcaaccccggaactgcctttgatactgttggtctggagttcgagagaggtgggtggaattccgagtgtagaggtgaaattcgtagatattcggaggaacaccagtggcgaaggcggcccactggctcgacactgacgctgaggcgcgaaagcgcggggagcaaacagg

SEQ ID NO: 812 - DNA, 253 bp, Unknown
  Description of Unknown: bacterium polynucleotide
  Alphaproteobacteria; Rhodobacteraceae
tacggagggggctagcgttgttcggaattactgggcgtaaagcgcgcgtaggcggatgttcaagtcgggggtgaaatcccggggctcaaccccggaactgcctccgatactggacgtctggaggacggaagaggcgagtggaatgccgagtgtagaggtgaaattcgtagatattcggcggaacaccagtggcgaaggcggctcactggctcgatactgacgctgaggtgcgaaagcgtggggagcaaacagg

SEQ ID NO: 813 - DNA, 253 bp, Amaricoccus sp.
  Alphaproteobacteria; Rhodobacteraceae; Amaricoccus
tacggagggggctagcgttgttcggaattactgggcgtaaagcgcacgtaggcggatcagtcagtcaggggtgaaatcccggggctcaaccccggaactgcctttgatactgctggtctggaggtcgagagaggcgagtggaattccgagtgtagaggtgaaattcgtagatattcggaggaacaccagtggcgaaggcggctcgctggctcgatactgacgctgaggtgcgaaagcgtggggagcaaacagg

SEQ ID NO: 814 - DNA, 253 bp, Paracoccus sp.
  Alphaproteobacteria; Rhodobacteraceae; Paracoccus
tacggagggggctagcgttgttcggaattactgggcgtaaagcgcacgtaggcggaccagaaagttgggggtgaaatcccggggctcaaccccggaactgccttcaaaactattggtctggagttcgagagaggtgagtggaataccgagtgtagaggtgaaattcgtagatattcggtggaacaccagtggcgaaggcggctcactggctcgatactgacgctgaggtgcgaaagcgtggggagcaaacagg

SEQ ID NO: 815 - DNA, 253 bp, Paracoccus aminovorans
  Alphaproteobacteria; Rhodobacteraceae; Paracoccus aminovorans
tacggagggggctagcgttgttcggaattactaggcgtaaagcgcacgtaggcggaccggaaagtcagaggtaaaatcccagggctcaaccttggaactgcctttgaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 816 - DNA, 253 bp, Rhodobacter sp.
  Alphaproteobacteria; Rhodobacteraceae; Rhodobacter
tacggagggggctagcgttgttcggaattactgggcgtaaagcgcacgtaggcggatcggacagtcagaggtgaaatcccagggctcaaccttggaactgcctttgaaactactggtctggagtttgagagaggtgagtggaattccgagtgtagaggtgaaattcgtagatattcggaggaacaccagtggcgaaggcggcccactggctcgatactgacgctgaggtgcgaaagcgtggggagcaaacagg

SEQ ID NO: 817 - DNA, 253 bp, Rhodobacter sp.
  Alphaproteobacteria; Rhodobacteraceae; Rhodobacter
tacggagggggctagcgttattcggaattactgggcgtaaagcgcacgtaggcggatcagaaagtcagaggtgaaatcccagggctcaaccttggaactgcctttgaaacttctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 818 - DNA, 253 bp, Rhodobacter sp.
  Alphaproteobacteria; Rhodobacteraceae; Rhodobacter
tacggagggggctagcgttgttcggaattactgggcgtaaagcgcacgtaggcggactggaaagtcaggggtgaaatcccggggctcaaccccggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 819 - DNA, 253 bp, Rhodobacter sp.
  Alphaproteobacteria; Rhodobacteraceae; Rhodobacter
tacggagggggctagcgttgttcggaattactgggcgtaaagcgcacgtaggcggattggaaagtcagaggtgaaatcccagggctcaaccttggaactgcctttgaaactcccagtcttgagttcgagagaggagagtggaattccgagtgtagaggtgaaattcgtagatattcggaggaacatcagtggcgaaggcggctcactggctcgatactgacgctgaggtgcgaaagcgtggggagcaaacagg

SEQ ID NO: 820 - DNA, 253 bp, Rubellimicrobium sp.
  Alphaproteobacteria; Rhodobacteraceae; Rubellimicrobium
tacggagggggttagcgttgttcggaatgactgggcgtaaagcgcgcgtaggcggatcggtaagttgggggtgaaatcccggggctcaaccccggaatggccttcaagactcccggtcttgagttcgagagaggtgagtggaattccgagtgtagaggtgaaattcgtagatattcggaggaacaccagtggcgaaggcggctcactggctcgacactgacgctgaggtgcgaaagcgtggggagcaaacagg

SEQ ID NO: 821 - DNA, 253 bp, Rubellimicrobium sp.
  Alphaproteobacteria; Rhodobacteraceae; Rubellimicrobium
tacggagggggttagcgttgttcggaatgactgggcgtaaagcgcgcgtaggcggatcgcaaagtcgggggtgaaatcccggggctcaaccccggaatggccttcgagactcgcggtctggagttcgagagaggtgggtggaattccgagtgtagaggtgaaattcgtagatattcggaggaacaccagtggcgaaggcggcccactggctcgacactgacgctgaggcgcgaaagcgcggggagcaaacagg

SEQ ID NO: 822 - DNA, 253 bp, Rubellimicrobium sp.
  Alphaproteobacteria; Rhodobacteraceae; Rubellimicrobium
tacggagggggttagcgttgttcggaatgactgggcgtaaagcgcgcgtaggcggatcgtcaagtcgggggtgaaatcccggggctcaaccccggaatggccttcgagactgtcggtcttgagttcgagagaggtgagtggaattccatgtgtagcggtgaaatgcgtagagatgtggaggaacaccagtggcgaaggcgactttctgatctgtaactgacgctgaggcgcgaaagcgtggggagcaaacagg

SEQ ID NO: 823 - DNA, 253 bp, Unknown
  Description of Unknown: bacterium polynucleotide
  Alphaproteobacteria; Rhodospirillaceae
tacgaagggggcgagcgttgttcggaattactgggcgtaaagggcgcgtaggcggcgacccaagtcagatgtgaaagtcctgggcttaacctggggactgcatttgatactgggttgcttgaattcgggagaggatagcggaattcccagtgtagaggtgaaattcgtagatattgggaagaacaccggtggcgaaggcggctatctggaccgacattgacgctgaggcgcgaaagcgtggggagcaaacagg

SEQ ID NO: 824 - DNA, 253 bp, Unknown
  Description of Unknown: bacterium polynucleotide
  Alphaproteobacteria; Rhodospirillaceae
tacgaagggggcaagcgttgttcggaattaccgggcgtaaagggcgcgtaggcggtgcactaagtcaggcgtgaaagccctgggctcaacccgggaattgcgcttgatactggtgcgcttgaatccaggagaggttggtggaattcccagtgtagaggtgaaattcgtagagattgggaagaacaccggtggcgaaggcggccaactggactggtattgacgctgaggcgcgaaagcgtggggagcaaacagg

SEQ ID NO: 825 - DNA, 253 bp, Unknown
  Description of Unknown: bacterium polynucleotide
  Alphaproteobacteria; Rhodospirillaceae
tacgaagggggcaagcgttgttcggaattactgggcgtaaagggcgcgtaggcggcttatcaagtcaggcgtgaaattcccgggctcaacctgggggctgcgcttgatactgatgagcttgaatgcgggagaggatagtggaattcccagtgtagaggtgaaattcgtagatattgggaagaacaccggtggcgaaggcggctatctggcccgtaattgacgctgaggcgcgaaagcgtggggagcaaacagg

SEQ ID NO: 826 - DNA, 253 bp, Unknown
  Description of Unknown: bacterium polynucleotide
  Alphaproteobacteria; Rhodospirillaceae
gacgaagggggctagcgttgttcggaattactgggcgtaaagcgtgtgtaggtggttgtcatagtcaggtgtgaaagccttgagctcaactcaagaaatgcacttgatactgggcgactagaggaccggagaggatagtggaattcccagtgtagtggtgaaatacgtagagattgggaagaacaccagtggcgaaggcggctatctggacggtttctggcactaagacacgaaagcgtggggagcaaacagg

SEQ ID NO: 827 - DNA, 253 bp, Unknown
  Description of Unknown: bacterium polynucleotide
  Alphaproteobacteria; Rhodospirillaceae
tacgaagggggcgagcgttgttcggaattactgggcgtaaagggcgcgtaggcggccgatcaagtcagatgtgaaagtcctgggcttaacctggggactgcatttgatactgattggcttgaatgcaggagaggatagcggaattcccagtgtagaggtgaaattcgtagatattgggaagaacaccggtggcgaaggcggctatctggactgtaattgacgctgaggcgcgaaagcgtggggagcaaacagg

SEQ ID NO: 828 - DNA, 252 bp, Unknown
  Description of Unknown: bacterium polynucleotide
  Alphaproteobacteria; Rhodospirillaceae
tacgaagggggctagcgttgttcggaattactgggcgtaagggcgcgtaggctgtgctgtaagtcaggcgtgaaagccccgggctcaacctgggaattgcgcttgatactgcggcgctggaaggtgggggaggatggcggaattcccagtgtagaggtgaaattcgtagatattgggaagaacaccggtggcgaaggcggccatctggcccacatttgacgctgaggcgcgaaagcgtggggagcaaacagg

SEQ ID NO: 829 - DNA, 254 bp, Unknown
  Description of Unknown: bacterium polynucleotide
  Alphaproteobacteria; Rhodospirillaceae
tacggagggggctagcgttgtacggaattactgggcgtaaagggcgcgcaggcggctgctcaagtcaggcgtgaaaggcctgggctcaacccgggaattgtgcttgagactgggctggcttgagtgcgggagaggatggcggaattcccagtgtagaggtgaaattcgtagatattgggaagaacaccggtggcgaaggcggccatctggaccgtaactgacgctgaggcgcgaaagcgtggggagcaaacagg

SEQ ID NO: 830 - DNA, 253 bp, Unknown
  Description of Unknown: bacterium polynucleotide
  Alphaproteobacteria; Rhodospirillaceae
tacggagggtgcaagcgttaatcggaattactgggcgtaaagcgcacgtaggtggtttgttaagtcaggcgtgaaagccctgggctcaacctgggatgtgcgtttgatactggcaagcttgagtgcaggagaggatggtggaattcccagtgtagaggtgaaattcgtagatattgggaagaacaccggtggcgaaggcggccatctggactgcaactgacgctgaggcgcgaaagcgtggggagcaaacagg

SEQ ID NO: 831 - DNA, 253 bp, Unknown
  Description of Unknown: bacterium polynucleotide
  Alphaproteobacteria; Rhodospirillaceae
tacgaagggggctagcgttgttcggaattactgggcgtaaagggcgcgtaggctgtgctgtaagtcaggcgtgaaaggcccgggctcaacctgggaactgcgtttgatactgcggcgctggaatgcaggagaggatggcggaattcccagtgtagaggtgaaattcgtagatattgggaagaacaccggtggcgaaggcggccatctggcctgcaattgacgctgaggcgcgaaagcgtggggagcaaacagg

SEQ ID NO: 832 - DNA, 253 bp, Unknown
  Description of Unknown: bacterium polynucleotide
  Alphaproteobacteria; Rhodospirillaceae
tacgaagggggctagcgttgttcggaattactgggcgtaaagggcgcgtaggcggccattcaagttaggtgtgaaagccctgggctcaacctaggaattgcacttgatactgtttggcttgagttcgggagaggtgagtggaattcccagtgtagaggtgaaattcgtagatattgggaagaacaccagtggcgaaggcggctcactggaccgacactgacgctgaggcgcgaaagcgtggggagcaaacagg

SEQ ID NO: 833 - DNA, 253 bp, Unknown
  Description of Unknown: bacterium polynucleotide
  Alphaproteobacteria; Rhodospirillaceae
tacgaagggggctagcgttgttcggaattactgggcgtaaagggcgcgtaggcggtgctgtaagtcaggcgtgaaatccccgggctcaacctggggattgcgtttgatactgcagcgcttgaatgcaggagaggatggcggaattcccagtgtagaggtgaaattcgtagatattgggaagaacaccggtggcgagggcggccatctggcctgtaattgacgctgaggcgcgaaagcgtggggagcaaacagg

SEQ ID NO: 834 - DNA, 253 bp, Unknown
  Description of Unknown: bacterium polynucleotide
  Alphaproteobacteria; Rhodospirillaceae
tacgaagggggcgagcgttgttcggatttactgggcgtagagggcgcgcaggcggctcattttgtcaggcgtgaaagccccgggcttaacctgggaactgcgtttgatacggatgggctagagttcgggagaggagagtggaattcccagtgtagaggtgaaattcgtagatattgggaagaacaccggtggcgaaggcggctctctggaccgatactgacgctgaggcgcgaaagcgtggggagcaaacagg

SEQ ID NO: 835 - DNA, 253 bp, Unknown
  Description of Unknown: bacterium polynucleotide
  Alphaproteobacteria; Rhodospirillaceae
tacgaagggggcaagcgttgttcggatttactgggcgtaaagggcgcgcaggcggctcttcaagtcaggcgtgaaagccccgggctcaacctgggaactgcgcttgagactggagagctagagttcgggagaggatggtggaattcccagtgtagaggtgaaattcgtagatattgggaagaacaccggtggcgaaggcggccatctggaccgagactgacgctgaggcgctaaagcgtggggagcaaacagg

SEQ ID NO: 836 - DNA, 253 bp, Unknown
  Description of Unknown: bacterium polynucleotide
  Alphaproteobacteria; Rhodospirillaceae
tacgaagggggctagcgttgttcggaattactgggcgtaaagcgcacgtaggcggcgcgtcaagtcaggggtgaaaggcctgggctcaacccgggaactgcctttgagactggcgtgctggagtccggaagagggtggcggaattcccagtgtagaggtgaaattcgtagatattgggaagaacaccggttgcgaaggcggccacctggtccggtactgacgctgaggtgcgaaagcgtggggagcaaacagg

SEQ ID NO: 837 - DNA, 253 bp, Unknown
  Description of Unknown: bacterium polynucleotide
  Alphaproteobacteria; Rhodospirillaceae
gacgaagggggctagcgttgttcggaattactgggcgtaaagcgcgcgtaggcggttttccaagtcaggcgtgaaagccccgggctcaacccgggaactgcgcttgatactgtgagacttgagaccgggagaggatagtggaattcccagtgtagaggtgaaattcgtagatattgggaagaacaccagtggcgaaggcggctatctggaccggtactgacgctgaggcgcgaaagcgtggggagcaaacagg

SEQ ID NO: 838 - DNA, 253 bp, Unknown
  Description of Unknown: bacterium polynucleotide
  Alphaproteobacteria; Rhodospirillaceae
tacgaagggggcgagcgttgttcggaattactgggcgtaaagggcgcgtaggcggtgctgtaagttaggtgtgaaaggcccgggcttaacctggggagtgcacttaagactgcagcgctgggatgcgagagaggatggcggaattcccagtgtagaggtgaaattcgtagatattgggaagaacaccggtggcgtaggcggccatctggctcgtgattgacgctgaggcgcgaaagcgtggggagcaaacagg

SEQ ID NO: 839 - DNA, 253 bp, Unknown
  Description of Unknown: bacterium polynucleotide
  Alphaproteobacteria; Rhodospirillaceae
gacgaagggggctagcgttgttcggaattactgggcgtaaagcgagtgtaggcggttgcccaagtcaggtgtgaaagccttgagctcaactcaagaaatgcacttggtactgggtggctagaggaccggagaggatagtggaattcccagtgtagtggtgaaatacgtagagattgggaagaacaccagtggcgaaggcggctatctggacggttactgacgctaagactcgaaagcgtggggagcaaacagg

SEQ ID NO: 840 - DNA, 253 bp, Unknown
  Description of Unknown: bacterium polynucleotide
  Alphaproteobacteria; Rhodospirillaceae
tacggagggggcaagcgttgttcggaattactgggcgtaaagggcgcgtaggcggttttgcaagtcagaggtgaaagccctgggctcaacctgggaggtgcctttgaaactgcgggacttgagtacgggagaggatggcggaattcccagtgtagaggtgaaattcgtagatattgggaagaacaccggtggcgaaggcggccatctggaccgtaactgacgctgaggcgcgaaagcgtggggagcaaacagg

SEQ ID NO: 841 - DNA, 253 bp, Unknown
  Description of Unknown: bacterium polynucleotide
  Alphaproteobacteria; Rhodospirillaceae
tacggagggggcaagcgttgttcggaattactgggcgtaaagggcgcgtaggcggcgtgacaggtcaggcgtgaaagccccgggctcaacctgggaactgcgcttgatacggtcatgctagaggttgggagaggagagtggaattcccagtgtagaggtgaaattcgtagatattgggaagaacaccagtggcgaaggcggctctctggcccatacctgacgctgaggcgcgaaagcgtggggagcaaacagg

SEQ ID NO: 842 - DNA, 253 bp, Unknown
  Description of Unknown: bacterium polynucleotide
  Alphaproteobacteria; Rhodospirillaceae
tacgaagggggcgagcgttgttcggatttactgggcgtaaagggcgcgcaggcggccacatttgtcaggcgtgaaagccccgggcttaacctgggaggtgcgtttgatacggtgtggctagagttcgggagaggagagtggaattcccagtgtagaggtgaaattcgtagatattgggaagaacaccggtggcgaaggcggctctctggaccgatactgacgctgaggcgcgaaagcgtggggagcaaacagg

SEQ ID NO: 843 - DNA, 253 bp, Unknown
  Description of Unknown: bacterium polynucleotide
  Alphaproteobacteria; Rhodospirillaceae
tacgaagggggcgagcgttgttcggatttactgggcgtaaagggcgcgtaggcggccatctttgtcgagtgtgaaagccccgggctcaacctgggaactgcgctcgaaacggggtggctagagatcgggagaggagcgtggaattcccagtgtagaggtgaaattcgtagatattgggaagaacaccggtggcgaaggcggcgctctggaccgagactgacgctgaggcgcgaaagcgtggggagcaaacagg

SEQ ID NO: 844 - DNA, 253 bp, Unknown
  Description of Unknown: bacterium polynucleotide
  Alphaproteobacteria; Rhodospirillaceae
tacgaagggggcaagcgttgttcggaattactgggcgtaaagcgagtgtaggtggttgtcatagtcaggtgtgaaagccctgagctcaactcaagaaatgcacttgatactgggcagctagagggccggagaggatagtggaattcccagtgtagtggtgaaatacgtagagattgggaagaacaccagtggcgaaggcggctatctggacggtttctgacactaagactcgaaagcgtggggagcaaacagg

SEQ ID NO: 845 - DNA, 253 bp, Unknown
  Description of Unknown: bacterium polynucleotide
  Alphaproteobacteria; Rhodospirillaceae
gacgaagggggctagcgttgttcggaattactgggcgtaaagcgcgtgtaggcggttgtccaagttggatgtgaaagccttgagctcaactcaagaaatgcattcaggactggatgactagaggaccggagaggatagtggaattcccagtgtagtggtgaaatacgtagagattgggaagaacaccagtggcgaaggcggctacctggacggtttctgacgctaagacgcgaaagcgtggggagcaaacagg

SEQ ID NO: 846 - DNA, 253 bp, Unknown
  Description of Unknown: bacterium polynucleotide
  Alphaproteobacteria; Rhodospirillaceae
gacgaagggggctagcgttgttcggaattactgggcgtaaagcgagtgtaggtggttgtcatagtcaggcgtgaaagcctcgagctcaactcgagaaatgcgcttgatactgggcagctagaggaccggagaggatagtggaattcccagtgtagtggtgaaatacgtagagattgggaagaacaccagtggcgaaggcggctatctggacggtttctgacactaagactcgaaagcgtggggagcaaacagg

SEQ ID NO: 847 - DNA, 253 bp, Unknown
  Description of Unknown: bacterium polynucleotide
  Alphaproteobacteria; Rhodospirillaceae
tacgaagggggcgagcgttgttcggacttactgggcgtaaagggcgcgtaggcggccatctttgtcaggcgtgaaagccccgggctcaacctgggaggtgcgtctgggacggggtggctagagatcgggagaggagagtggaattcccagtgtagaggtgaaattcgtagatattgggaagaacaccggtggcgaaggcggctctctggaccgatactgacgctgaggcgcgaaagcgtggggagcaaacagg

SEQ ID NO: 848 - DNA, 253 bp, Unknown
  Description of Unknown: bacterium polynucleotide
  Alphaproteobacteria; Rhodospirillaceae
tacgaagggggcgagcgttgttcggaattactgggcgtaaagggcgcgtaggcggcgcaccaagtcaggcgtgaaagccctgggcttaacccaggaattgcgtttgagactggcgtgctggagtgcaggagaggtcggcggaattcccagtgtagaggtgaaattcgtagagattgggaagaacaccggtggcgtaggcggccgactggactgtaactgtcgctgaggcgcgaaagcgtggggagcaaacagg

SEQ ID NO: 849 - DNA, 253 bp, Unknown
  Description of Unknown: bacterium polynucleotide
  Alphaproteobacteria; Rhodospirillaceae
tacgaagggggcgagcgttgttcggaattactgggcgtaaagggcgcgtaggcggccatctttgtcaggcgtgaaagccctgggctcaacctaggaattgcgcttgggacgggatggctagagttcgggagaggagagtggaattcccagtgtagaggtgaaattcgtagatattgggaagaacaccagtggcgaaggcggctctctggaccgatactgacgctgaggcgcgaaagcgtggggagcaaacagg

SEQ ID NO: 850 - DNA, 253 bp, Unknown
  Description of Unknown: bacterium polynucleotide
  Alphaproteobacteria; Rhodospirillaceae
tacgaagggggcgagcgttgttcggatttactgggcgtaaagggcgcgcaggcggctccacaagtcaggcgtgaaagccccgggcttaacctgggaattgcgtctgggactgtggggctagagatcgggagaggagagtggaattcccagtgtagaggtgaaattcgtaggtattgggaagaacaccggtggcgaaggcggctctctggactgatactgacactggggtgcgaaagcgtggggagcaaacagg

SEQ ID NO: 851 - DNA, 253 bp, Unknown
  Description of Unknown: bacterium polynucleotide
  Alphaproteobacteria; Rhodospirillaceae
tacgaagggggctagcgttgttcggaattactgggcgtaaagggcgcgtaggcggttttgtcagtcaggcgtgaaagccctgggctcaacctgggatgtgcgcttgatactgcaaggcttgagtgcaggagaggatggtggaattcccagtgtagaggtgaaattcgtagatattgggaagaacaccggtggcgaaggcggccatctggactgcatctgacgctgaggcgcgaaagcgtggggagcaagcagg

SEQ ID NO: 852 - DNA, 253 bp, Unknown
  Description of Unknown: bacterium polynucleotide
  Alphaproteobacteria; Rhodospirillaceae
tgcgaagggggctagcgttgttcggaattactggacgtaaagggcgcgtaggcggccgtttaagttaggtgtgaaagtcctgggctcaacctggggactgcacttaatactggatggcttgaattcgggagaggatagcggaattcccagtgtagaggtgaaattcgtagatattgggaagagcaccggtggcgaaggcggctatctggaccgacattgacgctgaggcgcgaaagcgtggggagcaaacagg

SEQ ID NO: 853 - DNA, 253 bp, Unknown
  Description of Unknown: bacterium polynucleotide
  Alphaproteobacteria; Rhodospirillaceae
tacgaagggggcgagcgttgttcggaatcactgggcgtaaagggcgcgtaggcggcggatcaagtcaggcgtgaaagccccgggctcaacctgggaggtgcgcttgggactggtttgctggagttcgggagaggagcgtggaattcccagtgtagaggtgaaattcgtagatattgggaagaacaccggtggcgaaggcggcgctctggcccgagactgacgctgaggcgcgaaagcgtggggagcaaacagg

SEQ ID NO: 854 - DNA, 253 bp, Unknown
  Description of Unknown: bacterium polynucleotide
  Alphaproteobacteria; Rhodospirillaceae
tacggagggggctagcgttgttcggatttactgggcgtaaagggcgcgtaggcggatgttcgcgtcagaggtgaaagccccgggctcaacctgggaactgcctttgaaacgggacatcttgagttcgggagagggtagcggaattcccagtgtagaggtgaaattcgtagatattgggaagaacaccggtggcgaaggcggctacctggcccgatactgacgctgaggcgcgaaagcgtggggagcaaacagg

SEQ ID NO: 855 - DNA, 253 bp, Unknown
  Description of Unknown: bacterium polynucleotide
  Alphaproteobacteria; Rhodospirillaceae
tacgaagggggcaagcgttgttcggaattactgggcgtaaagggcgcgtaggcggcttatcaagtcaggcgtgaaatccccgggctcaacctgggggctgcgcttgatactgatgagcttgaatgcgggagaggatagtggaattcccagtgtagaggtgaaattcgtagagagggggaagaaaaaagggggagaaggcggctatctggcccgtgattgacgctgaggcgcgaaagcgtggggagcaaacagg

SEQ ID NO: 856 - DNA, 253 bp, Azospirillum sp.
  Alphaproteobacteria; Rhodospirillaceae; Azospirillum
tacgaagggggctagcgttgttcggaattactgggcgtaaagggcgcgtaggcggcctgtttagtcaggagtgaaagccccgagcttaacctgggaatggctttcgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacagg

SEQ ID NO: 857 - DNA, 253 bp, Azospirillum sp.
  Alphaproteobacteria; Rhodospirillaceae; Azospirillum
tacgaagggggcgagcgttgttcggaattactgggcgtaaagggcgcgtaggcggcccgatcagtcagaagtgaaagccccgggctcaacctgggaacggcttttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacagg

SEQ ID NO: 858 - DNA, 253 bp, Azospirillum sp.
  Alphaproteobacteria; Rhodospirillaceae; Azospirillum
tacgaagggggctagcgttgttcggaattactgggcgtaaagggcgcgtaggcggccttgtcagtcagaagtgaaagccccgggctcaacctgggaattgcttttgatactgcaaggctagagtttcggagaggatggtggaattcccagtgtagaggtgaaattcgtagatattgggaagaacaccggtggcgaaggcggccatctggacgaacactgacgctgaggcgcgaaagcgtggggagcaaacagg

SEQ ID NO: 859 - DNA, 253 bp, Azospirillum irakense
  Alphaproteobacteria; Rhodospirillaceae; Azospirillum irakense
tacgaagggggctagcgttgttcggaattactgggcgtaaagggcgcgtaggcggcgcatcaagtcaggcgtgaaagccccgggcttaacctgggaattgcgcttgagactggtgtgcttgagtaccggagaggtgggtggaattcccagtgtagaggtgaaattcgtagatattgggaagaacaccggtggcgaaggcggcccactggacggttactgacgctgaggcgcgaaagcgtggggagcaaacagg

SEQ ID NO: 860 - DNA, 253 bp, Inquilinus limosus
  Alphaproteobacteria; Rhodospirillaceae; Inquilinus limosus
tacgaagggggcaagcgttgttcggaatgactgggcgtaaagggcgcgtaggcggttcgttgcgtcagatgtgaaagccccgggctcaacctgggaactgcatttgatacgggcgggcttgaatccaagagagggtggtggaattcccagtgtagaggtgaaattcgtagatattgggaagaacaccagtggcgaaggcggccacctggcttggtattgacgctgaggcgcgaaagcgtggggagcaaacagg

SEQ ID NO: 861 - DNA, 253 bp, Inquilinus sp.
  Alphaproteobacteria; Rhodospirillaceae; Inquilinus
tacgaagggggcaagcgttgttcggaatgactgggcgtaaagggcgcgtaggcggtgcgttgcgtcagatgtgaaatccccgggctcaacctgggaatggcatttgatacgggcgtactggaatccgtgagaggttggtggaattcccagtgtagaggtgaaattcgtagatattgggaagaacaccagtggcgaaggcggccaactggcacggtattgacgctgaggcgcgaaagcgtggggagcaaacagg

SEQ ID NO: 862 - DNA, 253 bp, Phaeospirillum fulvum
  Alphaproteobacteria; Rhodospirillaceae; Phaeospirillum fulvum
gacggaggaggctagcgttgttcggaattactgggcgtaaagcgtgcgcaggttgtgagttcagttggatgtgaaagcccggggcttaacctcggatgtgcatccaatactggctcgctggaggttggaagaggagagtggaattcccagtgtagaggtgaaattcgtagatattgggaagaacaccagtggcgaaggcggctctctggtccatacctgacactcatgcacgaaagcgtggggagcaaacagg

SEQ ID NO: 863 - DNA, 253 bp, Phaeospirillum sp.
  Alphaproteobacteria; Rhodospirillaceae; Phaeospirillum
gacggaggaggctagcgttgttcggaattactgggcgtaaagcgtacgcaggtggcggttcaagtcggatgtgaaagcccggggctcaaccccggatgtgcatccgatactggattgctggagtccggaagaggagagcggaattcccagtgtagaggtgaaattcgtagatattgggaagaacaccagtggcgaaggcggctctctggtccggtactgacactcaagtacgaaagcggggggagcaaacagg

SEQ ID NO: 864 - DNA, 253 bp, Skermanella sp.
  Alphaproteobacteria; Rhodospirillaceae; Skermanella
tacgaagggggctagcgttgttcggaattactgggcgtaaagggcgcgtaggcggtgtgtcaagtcaggcgtgaaagccccgggctcaacctgggaaccgcgcttgagactggcacgctcgagttcgggagaggatggtggaattcccagtgtagaggtgaaattcgtagatattgggaagaacaccgatggcgaaggcagccatctggaccgacactgacgctgaggcgcgaaagcgtggggagcaaacagg

SEQ ID NO: 865 - DNA, 253 bp, Skermanella sp.
  Alphaproteobacteria; Rhodospirillaceae; Skermanella
tacgaagggggctagcgttgttcggaattactgggcgtaaagggcgcgtaggcggtacttcaagtcaggcgtgaaagccccgggctcaacctgggaaccgcgcttgagactggagaactagagttcgggagaggatggtggaattcccagtgtagaggtgaaattcgtagatattgggaagaacaccgatggcgaaggcagccatctggaccgacactgacgctgaggcgcgaaagcgtggggagcaaacagg

SEQ ID NO: 866 - DNA, 253 bp, Skermanella sp.
  Alphaproteobacteria; Rhodospirillaceae; Skermanella
tacgaaggaggctagcgttgttcggaattactgggcgtaaagggcgcgtaggcggtccctcaagtcaggcgtgaaagccccgggctcaacctgggaaccgcgcttgagactgatgggctagagttcgggagaggatggtggaattcccagtgtagaggtgaaattcgtagatattggaaagaacaccgatggcgaaggcagccatctggaccgacactgacgctgaggcgcgaaagcgtggggagcaaacagg

SEQ ID NO: 867 - DNA, 253 bp, Skermanella sp.
  Alphaproteobacteria; Rhodospirillaceae; Skermanella
tacgaagggggcgagcgttgttcggaattactgggcgtaaagggcgcgtaggcggtgcaccaagtcaggcgtgaaagccccgggctcaacctgggaacggcgcttgggactggtgcgctcgagttcgggagaggacggcggaattcccagtgtagaggtgaaattcgtagatatcgggaagaacaccgatggcgaaggcagccgtctggaccgacactgacgctgaggcgcgaaagcgtggggagcaaacagg

SEQ ID NO: 868 - DNA, 253 bp, Skermanella sp.
  Alphaproteobacteria; Rhodospirillaceae; Skermanella
tacgaagggggcgagcgttgttcggaattactgggcgtaaagggcgcgtaggcggtcggccgcgtcagatgtgaaagccccgggctcaacctgggaaccgcatttgagacgggtcgactcgagttcgggagaggatggtggaattcccagtgtagaggtgaaattcgtagatattgggaagaacaccgagggcgaaggcagccatctggaccgacactgacgctgaggcgcgaaagcgtggggagcaaacagg

SEQ ID NO: 869 - DNA, 253 bp, Telmatospirillum sp.
  Alphaproteobacteria; Rhodospirillaceae; Telmatospirillum
tacgaagggggctagcgttgttcggaattactgggcgtaaagcgcacgcaggcggctcgataaattagaagtgaaagccccgggcttaacctgggaattgcttttaagactgtcgagctagaatccagaagagggtagtggaattccgagtgtggaggtgaaattcgtagatattcggaagaacaccagtggcgaaggcgactacctggtctggcattgacgctcatgtgcgaaagcgtggggagcaaacagg

SEQ ID NO: 870 - DNA, 253 bp, Unknown
  Description of Unknown: bacterium polynucleotide
  Alphaproteobacteria; Rickettsiaceae
tacggggggagctagcgtttttcggaattactgggcgtaaagggcgtgtaggcggttaataaagttgaaagtgaaatccctgggcttaacctaggaactgctttcaaaactcattaactagaggacgatagaggatagtagaattcctagtgtagaggtgaaattcttagatattaggaggaataccggtggcgaaggcggctatctggatcgtttctgacgctgaggcgcgaaagcgtggggagcaaacagg

SEQ ID NO: 871 - DNA, 253 bp, Rickettsia sp.
  Alphaproteobacteria; Rickettsiaceae; Rickettsia
tacggagggggctagcgttgttcggaattactgggcgtaaagagcgcgtaggcggtttataaagttggaagtgaaagcccgaggcttaacctcggaattgcttacaaaactcataagctagagagcgacaggggatggtggaattcctagtgtagaggtggaattcttagatattaggaggaacaccggtggcgaaggcggccatctgggtcgaatctgacgctgaggcgcgaaagcgtggggagcaaacagg

SEQ ID NO: 872 - DNA, 253 bp, Rickettsia sp.
  Alphaproteobacteria; Rickettsiaceae; Rickettsia
gacggagggggctagcgttgttcggaattactgggcgtaaagagtgcgtaggtggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacagg

SEQ ID NO: 873 - DNA, 253 bp, Unknown
  Description of Unknown: bacterium polynucleotide
  Alphaproteobacteria; Sphingomonadaceae
tacggagggagctagcgttgttcggaattactgggcgtaaagcgcgcgtaggcggctttgtaagttagaggtgaaagcccggggcttaaccccggaactgcctttaagactgcatcgcttgaatccgggagaggtgagtggaattccgagtgtagaggtgaaattcgtagatattcggaagaacaccagtggcgaaggcggctcactggaccggtattgacgctgatgtgcgaaagcgtggggagcaaacagg

SEQ ID NO: 874 - DNA, 253 bp, Unknown
  Description of Unknown: bacterium polynucleotide
  Alphaproteobacteria; Sphingomonadaceae
tacggagggagctagcgttgttcggaattactgggcgtaaagcgtacgtaggcggctttgtaagttagaggtgaaagcccggagctcaactccggaattgcctttaagactgcatcgcttgaatcctggagaggtgagtggaattccgagtgtagaggtgaaattcgtagatattcggaagaacaccagtggcgaaggcggctcactggacaggtattgacgctgaggcacgaaagcgtggggagcaaacagg

SEQ ID NO: 875 - DNA, 253 bp, Unknown
  Description of Unknown: bacterium polynucleotide
  Alphaproteobacteria; Sphingomonadaceae
tacggagggggctagcgttattcggaattactgggcgtaaagcgcacgtaggcggctgttcaagtcagaggtgaaagcccggagctcaactccggaactgcctttgaaactagatagctagaatcacggagaggtaagtggaattccgagtgtagaggtgaaattcgtagatatccggaagaacaccagtggcgaaggcggcttactggacgtgtattgacgctgaggtgcgaaagcgtggggagcaaacagg

SEQ ID NO: 876 - DNA, 253 bp, Unknown
  Description of Unknown: bacterium polynucleotide
  Alphaproteobacteria; Sphingomonadaceae
tacggagggggctagcgttgttcggaattactgggcgtaaagcgtacgtaggcggctttgtaagttagaggtgaaagcccggggctcaactccggaattgcctttaagactgcatcgcttgatcacgggagaggtgagtggaattccgagtgtagaggtgaaattcgtagatattcggaagaacaccagtggcgaaggcggctcactggaccgtagatgacgctgaggtacgaaagcgtggggagcaaacagg

SEQ ID NO: 877 - DNA, 253 bp, Unknown
  Description of Unknown: bacterium polynucleotide
  Alphaproteobacteria; Sphingomonadaceae
tacggagggagctagcgttgttcggaattactgggcgtaaagcgcgcgtaggcggctgttcaagtcagaggtgaaagcccggggctcaaccccggaactgcctttgaaactagatagctagaatcatggagaggtcagtggaattccgagtgtagaggtgaaattcgtagatattcggaagaacaccagtggcgaaggcgactgactggacatgtattgacgctgaggtgcgaaagcgtggggagcaaacagg

SEQ ID NO: 878 - DNA, 253 bp, Kaistobacter sp.
  Alphaproteobacteria; Sphingomonadaceae; Kaistobacter
tacggagggggctagcgttgttcggaattactgggcgtaaagcgcgcgtaggcggctttgtaagttagaggtgaaagcccagagcttaactctggaattgcctttaagactgcatcgcttgaatcatggagaggtgagtggaattccgagtgtagaggtgaaattcgtagatattcggaagaacaccagtggcgaaggcgactcactggacatgtattgacgctgaggtgcgaaagcgtggggagcaaacagg

SEQ ID NO: 879 - DNA, 253 bp, Kaistobacter sp.
  Alphaproteobacteria; Sphingomonadaceae; Kaistobacter
tacggagggggctagcgttgttcggaattactgggcgtaaagcgcacgtaggcggctttgtaagttagaggtgaaagcccggggctcaactccggaattgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacagg

SEQ ID NO: 880 - DNA, 253 bp, Kaistobacter sp.
  Alphaproteobacteria; Sphingomonadaceae; Kaistobacter
tacggagggggctagcgttgttcggaattactgggcgtaaagcgtacgtaggcggctttgtaagttagaggtgaaagcccagagctcaactctggaattgcctttaagactgcatcgcttgaatcgtggagaggttagtggaattccgagtgtagaggtgaaattcgtagatattcggaagaacaccagtggcgaaggcgactaactggacacgtattgacgctgaggtacgaaagcgtggggagcaaacagg

SEQ ID NO: 881 - DNA, 253 bp, Kaistobacter sp.
  Alphaproteobacteria; Sphingomonadaceae; Kaistobacter
tacggagggggctagcgttgttcggaattactgggcgtaaagcgcacgtaggcggctttgtaagttagaggtgaaagcccggggctcaactccggaattgcctttaagactgcatcgctcgaacgtcggagaggtaagtggaattccgagtgtagaggtgaaattcgtagatattcggaagaacaccagtggcgaaggcgacttactggacgattgttgacgctgaggtgcgaaagcgtggggagcaaacagg

SEQ ID NO: 882 - DNA, 253 bp, Kaistobacter sp.
  Alphaproteobacteria; Sphingomonadaceae; Kaistobacter
gacagagggtccaaacgttgttcggaattactgggcgtaaagcgcacgtaggcggctttgtaagttagaggtgaaagcccggagctcaactccggaattgcctttaagactgcatcgctcgaatcatggagaggtgagtggaattccgagtgtagaggtgaaatccgtagatattcggaagaacaccagtggcgaaggcgactcactggacatgtattgacgctgaggtgcgaaagcgtggggagcaaacagg

SEQ ID NO: 883 - DNA, 253 bp, Kaistobacter sp.
  Alphaproteobacteria; Sphingomonadaceae; Kaistobacter
tacggagggggctagcgttgttcggaattactgggcgtaaagcgcacgtaggcggctttgtaagttagaggtgaaagcccagggcttaaccctggaattgcctttaagactgcatcgctagaatcgtggagaggtaagtggaattccgagtgtagaggtgaaattcgtagatattcggaagaacaccagtggcgaaggcgacttactggacacgtattgacgccgaggagcgaaagcgtggggagcaaacagg

SEQ ID NO: 884 - DNA, 253 bp, Kaistobacter sp.
  Alphaproteobacteria; Sphingomonadaceae; Kaistobacter
tacggagggggctagcgttgttcggaattactgggcgtaaagcgcgcgtaggcggctttgtaagttagaggtgaaagcccggagctcaacttcggaatagcctttaagactgcatcgctagaatcgtggagaggtgagtggaattccgagtgtagaggtgaaattcgtagatattcggaagaacaccagtggcgaaggcgactcactggacacgtattgacgctgaggtgcgaaagcgtggggagcaaacagg

SEQ ID NO: 885 - DNA, 253 bp, Kaistobacter sp.
  Alphaproteobacteria; Sphingomonadaceae; Kaistobacter
tacggagggggctagcgttgttcggaattactgggcgtaaagcgcgcgtaggcggctttgtaagttagaggtgaaagcccggagcttaactccggaactgccttcaagactgcatcgctagaattgtggataggtgagtggaattccgagtgtagaggtgaaattcgtagatattcggaagaacaccagtggcgaaggcgactcactggacacatattgacgctgaggtgcgaaagcgtggggagcaaacagg

SEQ ID NO: 886 - DNA, 252 bp, Kaistobacter sp.
  Alphaproteobacteria; Sphingomonadaceae; Kaistobacter
tacggagggggctagcgttgttcggaattactgggcgtaaagcgcacgtaggcggctttgtaagttagaggtgaaagcccagggctcaaccctggaattgcctcaagactgcatcgcttgaacatcggagaggtaagtggaattccgagtgtagaggtgaaattcgtagatattcggaagaacaccagtggcgaaggcgacttactggacgattgttgacgctggggtgcgaaagcgtggggagcaaacagg

SEQ ID NO: 887 - DNA, 253 bp, Novosphingobium sp.
  Alphaproteobacteria; Sphingomonadaceae; Novosphingobium
tacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 888 - DNA, 253 bp, Novosphingobium sp.
  Alphaproteobacteria; Sphingomonadaceae; Novosphingobium
tacggagggagctagcgttgttcggaattactgggcgtaaagcgcacgtaggcggctactcaagtcgggggtgaaagcccggggctcaaccccggaactgccctcgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 889 - DNA, 253 bp, Sphingobium sp.
  Alphaproteobacteria; Sphingomonadaceae; Sphingobium
tacggagggggctagcgttgttcggaattactgggcgtaaagcgcacgtaggcggcgatttaagtcagaggtgaaagcccggggctcaaccccggaactgcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacagg

SEQ ID NO: 890 - DNA, 253 bp, Sphingobium sp.
  Alphaproteobacteria; Sphingomonadaceae; Sphingobium
tacggagggggctagcgttgttcggaattactgggcgtaaagcgcacgtaggcggcgatttaagtcaggggtgaaagcccagtgctcaacactggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggagagcaaacagg

SEQ ID NO: 891 - DNA, 253 bp, Sphingomonas sp.
  Alphaproteobacteria; Sphingomonadaceae; Sphingomonas
tacggagggagctagcgttgttcggaattactgggcgtaaagcgcacgtaggcggctttgtaagttagaggtgaaagcctggagctcaactccagaactgcctttgatactgcatggcttgaatccaggagaggtgagtggaattccgagtgtagaggtgaaattcgtagatattcggaagaacaccagtggcgaaggcggcccactggactggtattgacgctgaggcgcgaaagcgtggggagcaaacagg

SEQ ID NO: 892 - DNA, 253 bp, Sphingomonas sp.
  Alphaproteobacteria; Sphingomonadaceae; Sphingomonas
tacggagggagctagcgttgttcggaattactgggcgtaaagcgcacgtaggcggttttgtaagtcagaggtgaaagcctggagctcaactccagaactgcctttaaaactgcatcgcttgaatccaggagaggtgagtggaattctgagtgtagaggtgaaattcgtagatattcggaagaacaccagtggcgaaggcggctcactggactggtattgacgctgaggtgcgaaagcgtggggagtaaacagg

SEQ ID NO: 893 - DNA, 253 bp, Sphingomonas sp.
  Alphaproteobacteria; Sphingomonadaceae; Sphingomonas
tacggagggagctagcgttgttcggaattactgggcgtaaagcgcacgtaggcggctttgtaagttaggggtgaaagcctggagctcaacttcagaattgcccttaagactgcatcgcttgaatccaggagaggtgagtggaactccgagtgtagaggtgaaattcgtagatattcggaagaacaccagtggcgaaggcggctcactggactggtattgacgctgaggtgcgaaagcgtggggagcaaacagg

SEQ ID NO: 894 - DNA, 253 bp, Sphingomonas sp.
  Alphaproteobacteria; Sphingomonadaceae; Sphingomonas
gacggggggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacagg

SEQ ID NO: 895 - DNA, 253 bp, Sphingomonas echinoides
  Alphaproteobacteria; Sphingomonadaceae; Sphingomonas echinoides
tacggagggagctagcgttattcggaattactgggcgtaaagcgcacgtaggcggctttgtaagtaaggggtgaaagcctggtgctcaacaccagaactgccctttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 896 - DNA, 253 bp, Sphingomonas sp.
  Alphaproteobacteria; Sphingomonadaceae; Sphingomonas
tacggagggggctagcgttattcggaattactgggcgtaaagcgcacgtaggcggctttgtaagtaagaggtgaaagcccggagctcaactccggaactgccttttagactgcatcgcttgaatccaggagaggtgagtggaattccgagtgtagaggtggaattcgtagatattcggaagaacaccagtggcgaaggcggctcactggactggtattgacgctgaggtgcgaaagcgtggggagcaaacagg

SEQ ID NO: 897 - DNA, 253 bp, Sphingomonas sp.
  Alphaproteobacteria; Sphingomonadaceae; Sphingomonas
tacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacagg

SEQ ID NO: 898 - DNA, 253 bp, Sphingomonas sp.
  Alphaproteobacteria; Sphingomonadaceae; Sphingomonas
tacggagggggctagcgttgttcggaattactgggcataaagcgcacgtaggcggcttcgtaagtcaggggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccggtattgacgctgtggtgcgaaagcgtggggagcaaacagg

SEQ ID NO: 899 - DNA, 253 bp, Sphingomonas wittichii
  Alphaproteobacteria; Sphingomonadaceae; Sphingomonas wittichii
tacggagggggctagcgttgttcggaattactgggcgtaaagcgcacgtaggcggcttcgtaagtcagaggtgaaagcctggggctcaaccccagaactgcctttgagactgcgaggctagaacgtcggagaggtgagtggaattccgagtgtagaggtgaaattcgtagatattcggaagaacaccagtggcgaaggcggctcactggacgactgttgacgctgaggtgcgaaagcgtggggagcaaacagg

SEQ ID NO: 900 - DNA, 253 bp, Sphingomonas sp.
  Alphaproteobacteria; Sphingomonadaceae; Sphingomonas
tacggagggagctagcgttattcggaattactgggcgtaaagcgcacgtaggcggctttgtaagttagaggtgaaagcctggagctcaactccagaactgcctttaagactgcatcgcttgaatccaggagaggtgagtggaattctgagtgtagaggtgaaattcgtaggtattcggaagaacactggtggcgaaggcggctcactggactggtattgacgctgaggtgcgaaggcgtggggagcaaacagg

SEQ ID NO: 901 - DNA, 253 bp, Sphingomonas sp.
  Alphaproteobacteria; Sphingomonadaceae; Sphingomonas
tacggagggggctagtgttgttcggaattactgggcgtaaagcgcacgtaggcggctttgtaagttagaggtgaaagcctggggctcaaccccagaattgcctttgatactgcaaggcttgaatccaggagaggtgagtggaattccgagtgtagaggtgaaattcgtagatattcggaagaacactagtggcgaaggcggctcactggactggtattgacgctgaggtgcgaaagcgtggggagcaaacagg

SEQ ID NO: 902 - DNA, 253 bp, Sphingomonas wittichii
  Alphaproteobacteria; Sphingomonadaceae; Sphingomonas wittichii
tacggagggggctagcgttgttcggaatcactgggcgtaaagcgcacgtaggcggctttgcaagtcagaggtgaaagcccggggctcaaccccggaatagcctttgagactgcatggcttgaacgtcggagaggtgagtggaattccgagtgtagaggtgaaattcgtagatattcggaggaacaccagtggcgaaggcggctcactggacgactgttgacgctgaggtgcgaaagcgtggggagcaaacagg

SEQ ID NO: 903 - DNA, 253 bp, Sphingomonas sp.
  Alphaproteobacteria; Sphingomonadaceae; Sphingomonas
tacggagggagctagcgttgttcggaattactgggcgtaaagcgcacgtaggcggctttgtaagttagaggtgaaagcctggagctcaactccagaattgcctttaagactgcatcgcttgaatccgggagaggtgagtggaattccgagtgtagaggtgaaattcgtagatattcggaagaacaccagcggcgaaggcggctcactggaccggcattgacgctgaggtgcgaaagcgtggggagcaaacagg

SEQ ID NO: 904 - DNA, 253 bp, Sphingomonas sp.
  Alphaproteobacteria; Sphingomonadaceae; Sphingomonas
tacggagagagctagcgttgttcggaattactgggcgtaaagcgcacgtaggcggctttgtgagttagaggtgaaagcctggggctcaactccagaactgcctttaagactgcatcgctagaatccaggagaggtgagtggaattccgagtgtaggggtgaaattcgtagatattcggaagaacaccagtggcgaaggcggcccactggactggtattgacgctgaggtgcgaaagcgtggggagcaaacagg

SEQ ID NO: 905 - DNA, 253 bp, Sphingomonas sp.
  Alphaproteobacteria; Sphingomonadaceae; Sphingomonas
tacggagggggctagcgttattcggaattactgggcgtaaagcgcacgtaggcggctttgtaagtcagaggcgaaagcctggagctcaactccagaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 906 - DNA, 253 bp, Sphingomonas wittichii
  Alphaproteobacteria; Sphingomonadaceae; Sphingomonas wittichii
tacggagggggctagcgttgttcggaattactgggcgtaaagcgtacgtaggcggctttgtaagttagaggtgaaagcccggggctcaaccccggaattgcctttaagactgcatcgcttgaatcgcggagaggtgagtggaattccgagtgtagaggtgaaattcgtagatattcggaagaacaccagtggcgaaggcggctcactggacgcgtattgacgctgaggtacgaaagcgtggggagcaaacagg

SEQ ID NO: 907 - DNA, 253 bp, Sphingomonas wittichii
  Alphaproteobacteria; Sphingomonadaceae; Sphingomonas wittichii
tacggagggggctagcgttgttcggaattactgggcgtaaagcgcacgtaggcggctttttaagtcaggggtgaaagcccggagctcaactccggaattgcctttgagactggatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacagg

SEQ ID NO: 908 - DNA, 253 bp, Sphingomonas azotifigens
  Alphaproteobacteria; Sphingomonadaceae; Sphingomonas azotifigens
tacggagggggctagcgttatccggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagcggcgaaggcggcgcactggtctggtattgacgctggggtgcgaaagcgtggggagcaaacagg

SEQ ID NO: 909 - DNA, 253 bp, Sphingomonas sp.
  Alphaproteobacteria; Sphingomonadaceae; Sphingomonas
tacggagggggctagcgttattcggaattactgggcgtaaagcgcacgtaggcggctttgtaagttagaggtgaaagcccagggctcaactctggaattgcctttgatactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 910 - DNA, 253 bp, Sphingomonas wittichii
  Alphaproteobacteria; Sphingomonadaceae; Sphingomonas wittichii
tacggagggggctagcgttgttcggaattactgggcgtaaagcgcacgtaggcggctttgtaagttagaggtgaaagcccggggctcaaccccgaaatagcctttaagactgcatcgcttgaacacgggagaggtgagtggaattccgagtgtagaggtgaaattcgtagatattcggaagaacaccagtggcgaaggcggctcactggaccgttgttgacgctgaggtgcgaaagcgtggggagcaaacagg

SEQ ID NO: 911 - DNA, 253 bp, Sphingomonas sp.
  Alphaproteobacteria; Sphingomonadaceae; Sphingomonas
tacggagggggctagcgttgttcggaattactgggcgtcaagcgcacctaggcggctttgtaagttagaggtgaaagcctggggctcaactctagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 912 - DNA, 253 bp, Sphingomonas wittichii
  Alphaproteobacteria; Sphingomonadaceae; Sphingomonas wittichii
tacggagggggctagcgttgttcggaattactgggcgtaaagcgcacgtaggcggcttggtaagttagaggtgaaagcctggagctcaactccagaattgcctttaagactgccgagctagcaggtgagagaggtaagtggaattccgagtgtagaggtgaaattcgtagatattcggaagaacaccagtggcgaaggcggcttactggctcatactggacgctgaggtgcgaaagcgtggggagcaaacagg

SEQ ID NO: 913 - DNA, 253 bp, Sphingomonas sp.
  Alphaproteobacteria; Sphingomonadaceae; Sphingomonas
tacggagggggctagcgttgttcggaattactgggcgtaaagcgcacgtaggcggccgtttcagttagaggtgaaagcccggggctcaaccccggaattgcctttgatactggacggcttgaatccgggagaggtgagtggaattccgagtgtagaggtgaaattcgtagatattcggaagaacaccagtggcgaaggcggctcactggaccggcattgacgctgaggtgcgaaagcgtggggagcaaacagg

SEQ ID NO: 914 - DNA, 253 bp, Sphingomonas azotifigens
  Alphaproteobacteria; Sphingomonadaceae; Sphingomonas azotifigens
tacgaagggggctagcgttgttcggaattactgggcgtaaagcgcacgtaggcggttttgtaagtcagaggtgaaagcctggagctcaactccagaactgcctttgagactgcgagacttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 915 - DNA, 253 bp, Sphingomonas wittichii
  Alphaproteobacteria; Sphingomonadaceae; Sphingomonas wittichii
tacggagggggctagcgttgttcggaattactgggcgtaaagcgtacgtaggcggttttgtaagttagaggtgaaagcccggagctcaacttcggaattgcctttaagactgcatcacttgaacgtcggagaggtgagtggaattccgagtgtagaggtgaaattcgtagatattcggaagaacaccagtggcgaaggcggctcactggacgactgttgacgctgaggtacgaaagcgtggggagcaaacagg

SEQ ID NO: 916 - DNA, 253 bp, Sphingomonas wittichii
  Alphaproteobacteria; Sphingomonadaceae; Sphingomonas wittichii
tacggagggagctagcgttgttcggaattactgggcgtaaagcgtacgtaggcggtttaataagtcaggggtgaaagcccagagctcaactctggaactgcctttgagactgttagactagaacatagaagaggtaagtggaattccgagtgtagaggtgaaatccgtagatattcggaagaacaccagtggcgaaggcgacttactggtctatagttgacgctgaggtacgaaagcgtgggtagcaaacagg

SEQ ID NO: 917 - DNA, 253 bp, Sphingopyxis alaskensis
  Alphaproteobacteria; Sphingomonadaceae; Sphingopyxis alaskensis
tacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 918 - DNA, 253 bp, Sphingopyxis sp.
  Alphaproteobacteria; Sphingomonadaceae; Sphingopyxis
tacgaggggagctagcgttgttcggaattactgggcgtaaagcgcgcgtaggcggctttttaagtcagaggtgaaagcccggggctcaaccccggaattgcctttgaaactggaaagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 919 - DNA, 253 bp, Sphingopyxis sp.
  Alphaproteobacteria; Sphingomonadaceae; Sphingopyxis
tacggagggagctagcgttgttcggaattgctgggcgtaaagcgcgcgtaggcggttttttaagtcagaggtgaaagcccggggctcaaccccggaattgcctttgaaactggaaaacttgaatcttgcagaggtcggtggaattccgagtgtagaggtgaaattcgtagatattcggaagaacaccagtggcgaaggcgactgactggacaagtattgacgctgaggtgcgaaagcgtggggagcaaacagg

SEQ ID NO: 920 - DNA, 253 bp, Labrys sp.
  Alphaproteobacteria; Xanthobacteraceae; Labrys
tacgaagggggctagcgttgttcggaatcactgggcgtaaagcgcacgtaggcggattgttaagtcgggggtgaaatcctgaggctcaacctcagaactgccttcgatactggcgatcttgagtccggaagaggttggtggaacagctagtgtagaggtgaaattcgtagatattagctagaacaccagtggcgaaggcggccaactggtccggaactgacgctgaggtgcgaaagcgtggggagcaaacagg

SEQ ID NO: 921 - DNA, 253 bp, Unknown
  Description of Unknown: bacterium polynucleotide
  Anaerolineae
cacgtaggatccaagcgttatccggatttactgggcgtaaagcgcgtgtaggtggtttgttaagttgggtgttaaatctctcggctcaactgagaggtgtcgctcaaaactagcagactggaggacggtagaggaaggtggaattccgggtgtagtggtgaaatgcgtagatatccggaggaacatcagtggcgaaggcggccttctggaccgctcctgacactccaacgcgaaagctaggggagcaaacggg

SEQ ID NO: 922 - DNA, 253 bp, Unknown
  Description of Unknown: bacterium polynucleotide
  Anaerolineae
aacgtaggaggcgagcgttatccggagttactgggcgtaaagcggatgtaggcggtggctcgcgtcggatgtgaaagctcctggctcaaccgggagagggcgtcggatacggggtcactagagggcagcagaggagcgtggaattccgggtgtagtggtgaaatgcgtagagatccggaggaacaccagaggcgcaggcgacgctctgggctgctactgacgctgagaaccgaaggcatggggagcgagcggg

SEQ ID NO: 923 - DNA, 253 bp, Unknown
  Description of Unknown: bacterium polynucleotide
  Anaerolineae
aacgtaggggacaagcgttatccggatttactgggcgtaaggcgcccgtaggcggctaaataagttggacgtgaaagctcccggcttaactgggagaggccgttcaaaactgtttagcttgagtgaggaagaggagagcagaattcccggtgtagtggtggaatgcgtagagatcgggaggaataccagtggcgaaagcggctctctggtcctaaactgacgctgaggggcgaaagcgtggggagcgaacggg

SEQ ID NO: 924 - DNA, 253 bp, Unknown
  Description of Unknown: bacterium polynucleotide
  Anaerolineae
aacgtaggaagcgagcgttatccggatttactgggcgtaaagcgcatgcaggcggtttgttaagttggacttgaaagctcctggctcaactgggagaggtggttcaaaactaacagactagagggtagacgaggagagcggaattcccggtgtagtggtgaaatgcgtagatatcgggaggaacaccagtggcgaaagcggctctctggactatttctgacgctcagatgcgaaagccaggggagagaacggg

SEQ ID NO: 925 - DNA, 253 bp, Unknown
  Description of Unknown: bacterium polynucleotide
  Anaerolineae
aacgtaggacgcaagcgttatccggagttactgggcgtaaagcgcgggcaggcggcttcgcaagttcgatgtgaaatctctcagctcaactgggagcagccattggaaactacggagctggagtctggcagaggtaggcggaattccgggtggagtggtgaaatgcgtagagatccggaggaacaccggaggcgaaggcggcctactgggccagtactgacgctgagccgcgaaagccaggggagcgaacggg

SEQ ID NO: 926 - DNA, 253 bp, Unknown
  Description of Unknown: bacterium polynucleotide
  Anaerolineae; A4b
aacgtaggagacgaacgttatccggagttactgggcgtaaagggcgtgtaggcggtttgttaagtctggcgtgaaagctctcggctaaaccgggagaggtcgttggatactggcaaactagaggatggtagaggcgtgtggaattccgggagtagtggtgaaatgcgtagagatccggaggaacaccagtggcgaaggcgacacgctgggccatacctgacgctaaagcgcgacagcatggggagcaaacggg

SEQ ID NO: 927 - DNA, 253 bp, Unknown
  Description of Unknown: bacterium polynucleotide
  Anaerolineae; A4b
aacgtaggaggcgagcgttatccggagttactgggcgtaaagcgtatgtaggcggttggacaagtcgcgtgtgaaagcgcccggctaaactgggcgaggacacgtaagactgttcggctagagggtggtagaggggtgcagaattccgggtgtagcggtgaaatgtgtagagatccggaggaataccagtggtgcagacggcgccctgggccatacctgacgctgagatacgaaagcgtggggagcgaacggg

SEQ ID NO: 928 - DNA, 253 bp, Unknown
  Description of Unknown: bacterium polynucleotide
  Anaerolineae; A4b
aacgtaggagacaaacgttatccggagttactgggcgtaaagggcgtgtaggtggttgcgtaagtctggcgtgaaatttttcggcttaaccgggaaaggtcgtcggatactgcgtagctagaggacggtagaggcgtgtggaattccgggagtagtggtgaaatgcgtagagatccggaggaacaccagtggcgaaggcgacacgctgggccgtacctgacactgatgcgcgacagcatggggagcaaacagg

SEQ ID NO: 929 - DNA, 253 bp, Unknown
  Description of Unknown: bacterium polynucleotide
  Anaerolineae; A4b
cacgtaggacgcaagcgttatccggaattactgggcgtaaagagcgtgtaggcggtgctgtaagtcaaccgtgaaagctcccggctaaactgggagaggtcggatgagactgcagcgctagtgggtcgtagaggaatgtggaattccgggtgtagtggtgaaatgcgtagagatccggaggaacaccagaggcgaaggcggcattctggacgacatcagacgctgagacgcgacagcacggggagcgaacggg

SEQ ID NO: 930 - DNA, 253 bp, Unknown
  Description of Unknown: bacterium polynucleotide
  Anaerolineae; A4b
aacgtaggacacaagcgttatccggagttactgggcgtaaagggcgtgtaggcggacgtgtaagtctattctgaaagctcctggctaaactgggagaggcgaatggagactgcatatctagagtgaggaagaggaaagtggaattccgcgtgtagtggtgaaatgcgtagagatgcggaggaacaccagtggcgaaagcgactttctggtccttaactgacgctgaggcgcgaaagcatggggagcgaacggg

SEQ ID NO: 931 - DNA, 253 bp, Unknown
  Description of Unknown: bacterium polynucleotide
  Anaerolineae; A4b
aacgtaggacacaagcgttatccggagttactgggcgtaaagggcgtgtaggcggatcggtaagtctgctctgaaagctcctggctaaactgggagaggcgagcggagactgtcggtctagagtgaggaagaggaaagtagaattccgcgtgtagtggtgaaatgcgtagagatgcggaggaacaccagtggcgaaagcggctttctggtccttaactgacgctgcggcgcgaaagcatggggagcgaacggg

SEQ ID NO: 932 - DNA, 253 bp, Unknown
  Description of Unknown: bacterium polynucleotide
  Anaerolineae; A4b
aacgtaggacgcaagcgttatccggaattactgggcgtaaagcgcgtgtaggcgggtgattaagtcattggtgaaagctccgggctaaactcggagaggtccgatgatactggtcatctagagggggtcagaggggtgtggaattccgggtgtagtggtgaaatgcgtagagatccggaggaacaccagaggcgaaggcgacaccctgggaccaacctgacgctgagacgcgaaagcatggggagcgaacggg

SEQ ID NO: 933 - DNA, 253 bp, Unknown
  Description of Unknown: bacterium polynucleotide
  Anaerolineae; A4b
aacgtaggacacgagcgttatccggagttactgggcgtaaagggcgttcaggtgggtgattaagttcgctatgaaagcgccgggctaaacccggcgaggctggcggatactggtcatctggagtgaggtagagggaagtagaattccgcgtgtagtggtgaaatgcgtagagatgcggaggaataccagtggcgaaggcgacttcctggaccttaactgacactgaagcgcgaaagcatggggagcgaacggg

SEQ ID NO: 934 - DNA, 253 bp, Unknown
  Description of Unknown: bacterium polynucleotide
  Anaerolineae; A4b
aacgtaggaggcaagcgttatccggagttactgggcgtaaagcgcgtgtaggtggatcggtaagttacttatgaaagcccctggctaaactaggggaggttgagtgatactgccagtcttgaatagaggagaggttgacggaattccgcgtgtagtggtgaaatgcgtagagatgcggaagaacaccagtggcgaaggcggtcaactggcctcatattgacactcagacgcgaaggcatgggtagcgaacggg

SEQ ID NO: 935 - DNA, 253 bp, Unknown
  Description of Unknown: bacterium polynucleotide
  Anaerolineae; A4b
aacgtaggaggcgagcgttatccggagttactgggcgtaaagcgcgtgtaggtggttggatacgtctgctgtgaaatgtcccggcttaaccgggagggtgcggcagatacggtctgacttgagggcgacagaggagcgtagaattccgggtgtagtggtgaaatgcgtagagatccggaggaataccagtggcgcaagcggcgctctgggtcgcaactgacactgagacgcgaaggcatggggagcgaacggg

SEQ ID NO: 936 - DNA, 253 bp, Unknown
  Description of Unknown: bacterium polynucleotide
  Anaerolineae; A4b
aacgtaggacacgagcgttatccggagttactgggcgtaaagggcgggtaggcggcgttgtaagtctggtgtgaaagccttcggcttaaccgagggaggacactggagactgcaaggctagaggcagatagaggggtgtagaattccgggtgtagtggtgaaatgcgtagagatccggaggaataccagaggcgaaggcggcaccctgggtctgacctgacgctgatccacgacagcatggggagcgaacggg

SEQ ID NO: 937 - DNA, 253 bp, Unknown
  Description of Unknown: bacterium polynucleotide
  Anaerolineae; A4b
tacgaagggggctagcgttatccggagttactgggcgtaaagcgcgtgtaggtgggttggtaagttacttatgaaagctcctggctaaactaggagaggttgagtgatactgccagtcttgaatagaggagaggttgacggaattccgcgtgtagtggtgaaatgcgtagagatgcggaagaacaccagtggcgaaggcggtcgactggcctcatattgacactcagacgcgaaggcatgggtagcgaacggg

SEQ ID NO: 938 - DNA, 253 bp, Unknown
  Description of Unknown: bacterium polynucleotide
  Anaerolineae; A4b
aacgtaggaggcaagcgttatctggagttactgggcgtaaagcgcgtgtaggtgggttggtaagttacttataaaagcccctggctaaactgggggaggttgagtgatactgccagtcttgaatagaggagaggatgacggaattccgcgtgtagtggtgaaatgcgtagagacgcggaagaacaccagtggcgaaggcggtcaactggcctcatattgacactcagacgcgaaggcatgggtagcgaatggg

SEQ ID NO: 939 - DNA, 253 bp, Unknown
  Description of Unknown: bacterium polynucleotide
  Anaerolineae; A4b
aacgtaggaggcaagcgttatccggagttactgggcgtaaagggcgtgcaggtggttcaataagttggttatgaaagctcctggctaaactgggagaggttgaccaagactgttgaacttgagtggatgagaggtaaacggaattccgcgtgtagtggtgaaatgcgtagagatgcggaggaacaccagtggcgaaggcggtttactggcatccaactgacactgagacgcgaaagcatgggtagcgaacggg

SEQ ID NO: 940 - DNA, 253 bp, Unknown
  Description of Unknown: bacterium polynucleotide
  Anaerolineae; A4b
aacgtaggaggcaagcgttatccggagtaactgggcgtaaagggcgagtaggtggttgcgtaagttggttatgaaagctcctggctaaactgggagaggttgaccaagactgcgcgacttgagtggagaagaggtaaacggaattccgcgtgtagtggtgaaatgcgtagagatgcggaagaacaccagtggcgaaggcggtttactggtctccaactgacactgaaccgcgaaagcatgggtagcgaacggg

SEQ ID NO: 941 - DNA, 253 bp, Unknown
  Description of Unknown: bacterium polynucleotide
  Anaerolineae; A4b
aacgtaggaggcaagcgttatccggagttactgggcgtaaagcgcatgtaggcggttgggcaagttgagtgtgaaagctcccggctaaactgggagaggacatttaagactgcccggctagaggcaggtagaggggcgcagaattcggggagtagcggtgaaatgtgtagagatcccgaggaataccagtggtgaagacggcgccctgggcctgtactgacgctgagatgcgaaagcgtggggagcgaacggg

SEQ ID NO: 942 - DNA, 253 bp, Unknown
  Description of Unknown: bacterium polynucleotide
  Anaerolineae; A4b
aacgtaggaggcgagcgttatccggagttactgggcgtaaagcgcatgtaggcggttggataagttgcgtgtgaaagctcctggctaaactaggagaggacaggcaagactgttcggctagagggtggtagaggggcacagaattcggggtgtagcggtgaaatgtgtagagatcccgaggaataccagtggtgaagacggtgccctgggccatacctgacgctgagatgcgaaagcgtggagagcgaacggg

SEQ ID NO: 943 - DNA, 253 bp, Unknown
  Description of Unknown: bacterium polynucleotide
  Anaerolineae; A4b
aacgtaggaggcgagcgttatccggagttactgggcgtaaagagcgtgtaggcgggtacgcaagtttggcgtgagagcccccggctaaactgggagagtgcgctgaagactgcgtgtctagaggcgagtagagggacgtggaattccgggagtagtggtgaaatgcgtagagatccggaggaacaccagtggcgaaggcggcgtcctgggcttgacctgacgctgagacgcgacagcacggggagcgaacggg

SEQ ID NO: 944 - DNA, 253 bp, Unknown
  Description of Unknown: bacterium polynucleotide
  Anaerolineae; A4b
aacgtaggaggcgagcgttatccggagttactgggcgtaaagggtgtgtaggcggtggtgtaagtggggtgtgaaacgctcaggctaaacctgggaggtgcgcctcagactgcacgactagagtgggatagaggggcgtggaattccgggtggagcggtgaaatgtgtagagatccggaggaacaccagaggcgcaagcggcgccctgggtcccaactgacgctgaaacacgaaagcttggggagcgaacggg

SEQ ID NO: 945 - DNA, 253 bp, Unknown
  Description of Unknown: bacterium polynucleotide
  Anaerolineae; A4b
tacgtaggaggcaagcgttatccggagtaactgggcgtaaagggcgagtaggtggttgtataagttggttatgaaagctcctggctaaactgggagaggctgaccaagactgtatgacttgagtggagaagaggtaaacggaattccgcgtgtagtggtgaaatgcgtagagatgcggaagaacaccagtggcgaaggcggtctactggtctccaactgacactgaaccgcgaaagcatgggtagcgaacggg

SEQ ID NO: 946 - DNA, 253 bp, Unknown
  Description of Unknown: bacterium polynucleotide
  Anaerolineae; A4b
aacgtaggagacgaacgttatccggagttactgggcgtaaagggcgtgtaggcggactgttaagtctggcgtgaaagctcccggctaaaccgggtgaggtcgttggatactggcagactagagggtggtagaggcgtgtggaattccgggtgtagtggtgaaatgcgtagagatccggaggaacaccagtggcgaaggcgacacgctgggccatacctgacgctaaagcgcgacagcatggggagcaaacagg

SEQ ID NO: 947 - DNA, 253 bp, Unknown
  Description of Unknown: bacterium polynucleotide
  Anaerolineae; A4b
aacgtaggaggcgagcgttatccggagttactgggcgtaaagcgcgtgtaggtggctggatacgtctgttgtgaaagctcccggcttaaccgggaagatgcggcagatacggttcggctggagggtgacagaggagcgtagaattccgggtgtagtggtgaaatgcgtagagatccggaggaataccagtggcgcaagcggcgctctgggtcgcacctgacactgagacgcgaaggcatggggagcgaacggg

SEQ ID NO: 948 - DNA, 253 bp, Unknown
  Description of Unknown: bacterium polynucleotide
  Anaerolineae; A4b
tacgtaggcagcaagcgttgttcggaattactgggcgtaaagagtgtgtaggcggtcgtccaagtcacccgtgaaagctcccggctaaactgggagaggtcgggtgagactggatggctagagggttgtagaggggtgtggaattccgggtgtagtggtgaaatgcgtagagatccggaggaacaccagaggcgaaggcggcaccctggacaacacctgacgctgagacgcgaaagcgcggggagcaaacggg

SEQ ID NO: 949 - DNA, 253 bp, Ardenscatena sp.
  Anaerolineae; Ardenscatenaceae; Ardenscatena
tacgtaggtggcgaacgttatccggaattactgggcgtaaagggtctgtaggcggtcttacaggtctggcgtgacaattctcggcttaactgagagagtgcgttggaaaccggaagactagagtcacgtcgaggtcggtggaattcccggtgtagtggtggaatgcgtagagatcgggaggaacccctaaagcgaaggcagccggctagacgatgattgacgctgagggacgatagcgtggggagcgaacagg

SEQ ID NO: 950 - DNA, 253 bp, Ardenscatena sp.
  Anaerolineae; Ardenscatenaceae; Ardenscatena
tacgtaggtggcgaacgttatccggagtgactgggtgtaaagggtccgtaggcgggccgttaagtctgacgtgaaagcgcccggctcaactgggcgagtgcgttggaaactgatggtcttgactcgcgcagaggtcggcggaattcccggtgtagtggtggaatgcgtagagatcgggaggaacctcgaaagcgaaggcagccgactgggggatgagtgacgctgagggacgaaagcgtggggagcgaacagg

SEQ ID NO: 951 - DNA, 253 bp, Unknown
  Description of Unknown: bacterium polynucleotide
  Anaerolineae; Caldilineaceae
tacgtaggtggcaagcgttatccggaattactgggcgtaaagcgcacgcaggcggctcgtcaagttcgacgtgaaagctcccggcttaactgggagaggtcgttgaagactgatgggcttgaggcaaggagaggggtgtagaattcccggtgtagtggaggaatgcgtagatatcggggggaataccagtggcgaaagcggcaccctagccttagcctgacgctcatgtgcgaaagcgtggggagcgaacggg

SEQ ID NO: 952 - DNA, 253 bp, Unknown
  Description of Unknown: bacterium polynucleotide
  Anaerolineae; Caldilineaceae
tacgtaggtgacaagcgttatccggaattattgggcgtaaagcgcacgcaagcggttggacaagtccggcgtgaaatctcccagcttaactgggagcggtcgcgggaaactgttcgacttgaggcgatgagaggggtgcagaattcccggtgtagtggtggaatgcgtagatatcgggaggaataccagtggcgaaagcggcaccctggcgtcgtactgacgcacatgtgcgaaagcgtggggagcgaacggg

SEQ ID NO: 953 - DNA, 252 bp, Unknown
  Description of Unknown: bacterium polynucleotide
  Anaerolineae; oc28
acgtaggtggcgagcgttatccggatttactgggcgtaaagggtgtgcaggcggactgttaggtggtgcatgaaatctccgcgcttaacgtggagaggctgtgccagactggcagtctcgagtacgagagagggttgtggaattccgggtgtagtggtgaaatgcgtagagatccggaggaacaccagaggcgaaggcggcaacctggctcgttactgacgctcatacacgacagcatggggagcgaacggg

SEQ ID NO: 954 - DNA, 253 bp, Unknown
  Description of Unknown: bacterium polynucleotide
  Anaerolineae; oc28
aacgtaggtggcgagcgttatccggatttgctgggcgtaaagcgtgtgcaggcgggatggtaagtggtgtatgaaatctcccagcttagctgggaggggttatgccagactgccattctagagtgcgagagaggaacgtggaattccgggtgtagtggtggaatgcgtagagatccggaggaaccccagaggcgaaggcggcgttctggctcgcaactgacgctcagacacgacagcatggggagcgaacggg

SEQ ID NO: 955 - DNA, 253 bp, Unknown
  Description of Unknown: bacterium polynucleotide
  Anaerolineae; oc28
aacgtaggtggcgagcgttatccggatttactgggcgtaaagcgtgtgcaggcggggtaataagtggtgtatgaaatctcccagcttaactgggaggggttatgccagactgttactctagagtgcgagagaggaacgtggaattccgggagtagtggtgaaatgcgtagagatccggaggaaccccagaggcgaaggcggcgttctggctcgcaactgacgctcagacacgacagcatggggagcgaacggg

SEQ ID NO: 956 - DNA, 253 bp, Unknown
  Description of Unknown: bacterium polynucleotide
  Anaerolineae; oc28
aacgtaggtggcgagcgttatccggatttactgggcgtaaagggtgtgcaggcgggcgactaagtggtgcatgaaatctccgcgcttaacgtggagaggctgtgccagactggccgtctcgagtacgagagagggttgtggaattccgggagtagtggtgaaatgcgtagagatctggaggaacaccagaggcgaaggcggcaacctggctcgttactgacgctcatacacgacagcgtggggatcaaacagg

SEQ ID NO: 957 - DNA, 254 bp, Unknown
  Description of Unknown: bacterium polynucleotide
  Anaerolineae; SJA-101
aacgtaggaggcgagcgttatccggatttactgggcgtaaagcgcgtgcaggcggtttggtaagttgtgcgtgaaagctcccaggctcaaccgggagaggccgtgcaagactgcccgactagaagtagagagaggccagtagaattccgggtgtagtggtgaaatgcgtagagatccggaggaataccagaagcgaaggcggctggctggctctaacttgacgctcagacgcgaaagcatggggagcgaacggg

SEQ ID NO: 958 - DNA, 253 bp, Unknown
  Description of Unknown: bacterium polynucleotide
  Armatimonadia
tacgtagggggcgagcgttgtccgaagttactgggcgtaaagcgcgtgtaggcgggtctttaagtgaggggtgaaaggtttgggcttaacccagacactgcctttcatactggagaccttgagtgcgggagaggcgagtggaatggtcggtgtagcggtgaaatgcgtagatatcgatcggaacacccatggcgaaggcagctcgctggcctgtaactgacgctgagacgcgaaagcgtggggagcaaacagg

SEQ ID NO: 959 - DNA, 253 bp, Unknown
  Description of Unknown: bacterium polynucleotide
  Armatimonadia
tacgaagggggcgagcgttgtccgaagttactgggcgtaaagagcgcgtaggcgggcttctaagtgagaggtgaaaggttcgggctcaacccggagagtgcctttcatactgggagccttgagtgcgggagaggcaagtggaatggtcggtgtagcggtgaaatgcgtagatatcgatcggaacacccgtggcgaaggcggcttgctggctcgcaactgacgctgaggcgcgaaagcgtggggagcaaacagg

SEQ ID NO: 960 - DNA, 253 bp, Unknown
  Description of Unknown: bacterium polynucleotide
  Armatimonadia
tacgtagggggcgagcgttgtccgaagttactgggcgtaaagcgcgcgtaggcgggttcttaagtgaggggtgaaaggtttgggctcaacccaaacactgcctttcatactgggagccttgagtatgggagaggcgagtggaatggtcggtgtagcggtgaaatgcgtagatatcgatcggaacacccatggcgaaggcagctcgctggcctaaaactgacgctgaggcgcgaaagcgtggggagcaaacagg

SEQ ID NO: 961 - DNA, 253 bp, Unknown
  Description of Unknown: bacterium polynucleotide
  Armatimonadia
tacgtagggggcgagcgttgtccgaagttactgggcgtaaagagcgcgtaggctggtctttaagtgagtggtgaaaggttcgggctcaacccggacactgcctttcatactggggaccttgagtgtgggagaggcgagtggaatggtcggtgtagcggtgaaatgcgtagatatcgatcggaacacccatggcgaaggcagctcgctggcctaacactgacgctgaggcgcgaaagcgtggggagcaaacagg

SEQ ID NO: 962 - DNA, 254 bp, Unknown
  Description of Unknown: bacterium polynucleotide
  Armatimonadia; Armatimonadaceae
tacgtagggggcgagcgttgtccgaagttactgggcgtaaagcgcgcgtaggcggccatttaagttcggggtgaaaggttcagcgctcaacgcgaacagtgccttgaatactgggtggcttgagttcgggagagggcagtggaattcctggtgtagcggtgaaatgcgtagatatcaggaggaacaccgatggcgaaggcagctgcctggcctagaactgacgctgaggtgcgaaagcgtggggagcgaacagg

SEQ ID NO: 963 - DNA, 253 bp, Unknown
  Description of Unknown: bacterium polynucleotide
  At12OctB3
tacggggggtgcgagcgttatccggattcactgggtttaaagggtgcgtaggcggctgaataagtcagtggtgaaagcccacagcttaactgtgaaactgccattgaaactgtttagcttgaatctggttgaagtgggcggaatacatcatgtagcggtgaaatgcttagatatgatgtagaacaccgattgcgaaggcagctcactaagccatcattgacgctggggcacgaaagcgtgggtagcgaacagg

SEQ ID NO: 964 - DNA, 253 bp, Unknown
  Description of Unknown: bacterium polynucleotide
  At12OctB3
tacggagggtgcaagcgttatccggattcactgggtttaaagggtgcgtaggcggcttgataagtcattggtgaaagctcgtggctcaaccgcgaaactgccaatgaaactgccaagcttgaatctggttgaagtgggcggaatacaacatgtagcggtgaaatgcttagatatgttgtagaacaccgattgcgaaggcagctcactaagccaacattgacgctgaggcacgaaagcgtgggtagcgaacagg

SEQ ID NO: 965 - DNA, 253 bp, Unknown
  Description of Unknown: bacterium polynucleotide
  Bacilli
tacgtaggtggcaagcgttgtccggaattattgggcgtaaagcgcgcgcaggtggtctcttaagtctgatgtgaaagcccccggctcaaccggggagggtcattggaaactgggagacttgagtgcaggagagaagagtggaattccacgtgtagcggtgaaatgcgtagagatgtggaggaacaccagtggcgaaggcgactctttggcctgtaactgacactgaggcgcgaaagcgtggggagcaaacagg

SEQ ID NO: 966 - DNA, 253 bp, Unknown
  Description of Unknown: bacterium polynucleotide
  Bacilli
tacgtaggtggcaagcgttgtccggaattattgggcgtaaagcgcgcgcaggcggcctcctaagtccgatgtgaaagcccacggctcaaccgtggagggtcattggaaactgggggacttgagtgcaggagagaagagtggaattccacgtgtagcggtgaaatgcgtagagatgtggaggaacaccagtggcgaaggcgactctttggcctgtaactgacgctgaggcgcgaaagcgtggggagcaaacagg

SEQ ID NO: 967 - DNA, 253 bp, Unknown
  Description of Unknown: bacterium polynucleotide
  Bacilli
tacgtaggtggcaagcgttgtccggatttattgggcgtaaagcgagcgcaggcggtttcttaagtctgatgtgaaagccctcggctcaaccgaggaaggtcattggaaactggggaacttgaatgcagaagaggagagtggaattccatgtgtagcggtgaaatgcgtagatatatggaggaacaccagtggcgaaggcgactctctggtctgtaattgacgctgaggctcgaaagcgtggggagcaaacagg

SEQ ID NO: 968 - DNA, 253 bp, Unknown
  Description of Unknown: bacterium polynucleotide
  Bacilli; Exiguobacteraceae
tacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacagg

SEQ ID NO: 969 - DNA, 253 bp, Exiguobacterium sp.
  Bacilli; Exiguobacteraceae; Exiguobacterium
tacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacagg

SEQ ID NO: 970 - DNA, 253 bp, Abiotrophia sp.
  Bacilli; Aerococcaceae; Abiotrophia
tacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgtaactgacgctgaggctcgaaagcgtggggagcaaacagg

SEQ ID NO: 971 - DNA, 253 bp, Aerococcus sp.
  Bacilli; Aerococcaceae; Aerococcus
tacgtaggtggcaagcgttgtccggatttattgggcgtaaagggagcgcaggtggtttcttaagtctgatgtgaaagcccacggcttaaccgtggagggtcattggaaactggggaacttgagtacagaagaggaatgtggaactccatgtgtagcggtggaatgcgtagatatatggaagaacaccagtggcgaaggcgacattctggtctgttactgacactgaggctcgaaagcgtggggagcaaacagg

SEQ ID NO: 972 - DNA, 253 bp, Facklamia sp.
  Bacilli; Aerococcaceae; Facklamia
tacgtaggtggcaagcgttatccggatttattgggcgtaaagggagcgcaggcggttggttaagtctgatgtgaaagcccacggctcaaccgtggagttgcattggaaactggtcaacttgagtacagaagaggaaagcggaattccatgtgtagcggtgaaatgcgtagatatatggaggaacaccagtggcgaaggcggctttctggtctgaaactgacgctgaggctcgaaagcgtggggagcaaacagg

SEQ ID NO: 973 - DNA, 253 bp, Facklamia sp.
  Bacilli; Aerococcaceae; Facklamia
tacgtaggtcacaagcgttgtccggatttattgggcgtaaagggagcgcaggcggtttgttaagtctgatgtgaaagcccacggctcaaccgtggaacggcattggaaactggcaaacttgagtgcagaagaggaaagtggaattccatgtgtagcggtgaaatgcgtagatatatggaggaacaccagtggcgaaggcgactttctggtctgtaactgacgctgaggctcgaaagcgtggggagcgaacagg

SEQ ID NO: 974 - DNA, 253 bp, Alicyclobacillus sp.
  Bacilli; Alicyclobacillaceae; Alicyclobacillus
tacgtagggggcaagcgttgtccggattcactgggcgtaaagcgcgcgcaggcggtgatgtaagtctgaggtgaaaacccgaagctcaacttcgggactgccttggatactgcgtcacttgaggataggagaggcaaggggaattccacgtgtagcggtgaaatgcgtagagatgtggaggaacacctgtggcgaaggcgccttgctggcctatttctgacgctgaggcgcgaaagcgtggggagcaaacagg

SEQ ID NO: 975 - DNA, 253 bp, Alicyclobacillus sp.
  Bacilli; Alicyclobacillaceae; Alicyclobacillus
tacgtagggggcaagcgttgtccggaatcactgggcgtaaagcgcgcgcaggcggtctttcacgtccggggtgaaagcccagagctcaactctgggattgccttggatacggggagacttgaggatcggagaggcaaggggaattccacgtgtagcggtgaaatgcgtagagatgtggaggaacacctgtggcgaaggcggccacctggaccatgactgacgctgaggcacgaaagcgtggggagcaaacagg

SEQ ID NO: 976 - DNA, 253 bp, Alicyclobacillus sp.
  Bacilli; Alicyclobacillaceae; Alicyclobacillus
tacgtagggggcaagcgttgtccggaatcactgggcgtaaagcgcgcgcaggcggctatctacgtccggggtgaaagcccagagctcaactctgggactgccttggatacgggatggcttgaggatcggagaggcaaggggaattccacgtgtagcggtgaaatgcgtagagatgtggagggacacctgtggcgaaggcgccttgctggccgatttctgacgctgaggcgctaaagcgtggggagcaaacagg

SEQ ID NO: 977 - DNA, 253 bp, Unknown
  Description of Unknown: bacterium polynucleotide
  Bacilli; Bacillaceae
tacgtaggtggcaagcgttatccggaattattgggcgtaaagcgctcgcaggcggtcttttaagtctgatgtgaaagcccacggctcaaccgtggagggtcattggaaactgggagacttgagtgcagaagaggagagtggaattccacgtgcagcggtgaaatgcgtagagatgtggaggaacaccagtggcgaaggcgactctctggtctgtaactgacgctgaggagcgaaagcgtggggagcgaacagg

SEQ ID NO: 978 - DNA, 253 bp, Unknown
  Description of Unknown: bacterium polynucleotide
  Bacilli; Bacillaceae
tacgtaggtggcaagcgttgtccggaattattgggcgtaaagcgtacgcaggcggtttcttaagtctgatgtgaacgcccacggctcaaccgtggagggtcattggaaactggggaacttgagtacagaagaggagagtggaattccacgtgtagcggtgaaatgcgtagagatgtggaggaacaccagtggcgaaggcgactcactggtccggtactgacgctgaggtgcgaaagcgtggggagcaaacagg

SEQ ID NO: 979 - DNA, 253 bp, Unknown
  Description of Unknown: bacterium polynucleotide
  Bacilli; Bacillaceae
tacgtagagggcaagcgttgtccggaattattgggcgtaaagggcgtgcaggcggtttcttaagtctgatgtgaaatcttgtggcttaaccacaagcggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacagg

SEQ ID NO: 980 - DNA, 253 bp, Bacillus flexus
  Bacilli; Bacillaceae; Bacillus flexus
tacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacagg

SEQ ID NO: 981 - DNA, 253 bp, Bacillus sp.
  Bacilli; Bacillaceae; Bacillus
tacgtaggtggcaagcgttgtccggaattattgggcgtaaagcgcgcgcaggcggttccttaagtctgatgtgaaagcccacggctcaaccgttgggggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 982 - DNA, 253 bp, Bacillus ginsengihumi
  Bacilli; Bacillaceae; Bacillus ginsengihumi
tacgtaggtggcaagcgttgtccggaattattgggcgtaaagcgcgcgcaggcggtcttttaagtctgatgtgaaagcccacggctcaaccgtggagggtcattggaaactggaagacttgagtgcggaagaggagagtggaattccacgtgtagcggtgaaatgcgtagagatgtggaggaacaccagtggcgaaggcgactctctggtctgtaactgacgctgaggcgtgaaagcgtggggagcaaacagg

SEQ ID NO: 983 - DNA, 253 bp, Bacillus muralis
  Bacilli; Bacillaceae; Bacillus muralis
tacgtaggtggcaagcgttgtccggaattattgggcgtaaggcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctataactgtcactgaggcgcgaaagcgtggggagcaaacagg

SEQ ID NO: 984 - DNA, 253 bp, Bacillus coagulans
  Bacilli; Bacillaceae; Bacillus coagulans
tacgtaggtggcaagcgttgtccggaattattgggcgtaaagcgcgcgcaggcggcttcttaagtctgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 985 - DNA, 254 bp, Bacillus sp.
  Bacilli; Bacillaceae; Bacillus
tacgtaggtggcaagcgttgtccggaattattgggcgtagagcgcgcgcaggcggcctcttaagtctgatgtgaaagcccacggctcaaccgttgagggtcattggaaactgggggggcttgagtgcagaagaggagagcggaattccacgtgtagcggtgaaatgcgtagagatgtggaggaacaccagtggcgaaggcggctctctggtctgtaactggcgctgaggcgcgaaagcgtggggagcgaacagg

SEQ ID NO: 986 - DNA, 253 bp, Bacillus farraginis
  Bacilli; Bacillaceae; Bacillus farraginis
gacgaagggggctagcgttgttcggaattactgggcgtaaagggcgcgtaggcggtttgttaagtctgatgtgaaagcccacggctcaaccgtggagggtcattggaaactggaaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacagg

SEQ ID NO: 987 - DNA, 253 bp, Bacillus sp.
  Bacilli; Bacillaceae; Bacillus
tacgtaggtggcaagcgttgtccggaattattgggcgtaaagcgcgcgcaggcggtctcttaagtctgatgtgaaatcccgtggcttaaccacgggcggtcattggaaactgggggacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacagg

SEQ ID NO: 988 - DNA, 253 bp, Geobacillus sp.
  Bacilli; Bacillaceae; Geobacillus
tacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacagg

SEQ ID NO: 989 - DNA, 253 bp, Natribacillus halophilus
  Bacilli; Bacillaceae; Natribacillus halophilus
tacgtagggggcaagcgttgtccggaattattgggcgtaaagggcacgcaggcggtacggcaagtctgatgtgaaaggccggcgctcaacgccggaatggcattggaaactgtcgcacttgagtacggaagaggagagtggaattccacgtgtagcggtgaaatgcgtagagatgtggaggaacaccagtggcgaaggcgccttgctggccaatttctgacgctgaggcgcgaaagcgtggggagcaaacagg

SEQ ID NO: 990 - DNA, 253 bp, Terribacillus sp.
  Bacilli; Bacillaceae; Terribacillus
tacgtagggggcaagcgttgtccggaattattgggcgtaaagggctcgtaggcggtttcttaagtctgatgtgaaagcccacagctcaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggagcgaaagcgtggggagcaaacagg

SEQ ID NO: 991 - DNA, 253 bp, Virgibacillus sp.
  Bacilli; Bacillaceae; Virgibacillus
tacgtagggggcaagcgttgtccggaattattgggcgtaaagcgcgcgcaggcggtcctttaagtctgatgtgaaatctcacggcttaaccgtgagcggtcattggaaactgggggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcaaacagg

SEQ ID NO: 992 - DNA, 253 bp, Virgibacillus sp.
  Bacilli; Bacillaceae; Virgibacillus
tacgtagggggcaagcgttgtccggaattattgggcgtaaagcgcgcgcaggcggtcctttaagtctgatgtgaaagcccacggcttaaccgtggagggtcattggaaactggaggacttgagtacagaagaggagagtggaattccgcgtgtagcggtgaaatgcgtagagatgtggaggaacaccagtggcgaaggcgactctctggtctgtaactgacgctgaggtgcgaaagcgtgggtagcgaacagg

SEQ ID NO: 993 - DNA, 253 bp, Carnobacterium sp.
  Bacilli; Carnobacteriaceae; Carnobacterium
tacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacagg

SEQ ID NO: 994 - DNA, 253 bp, Desemzia sp.
  Bacilli; Carnobacteriaceae; Desemzia
tacgtagatggcaagcgttgtccggatttattgggcgtaaagcgagcgcaggcggttctttaagtctgatgtgaaagcccctggctcaaccagggagggtcattggaaactggagaacttgagtgcagaagaggaaagtggaattccatgtgtagcggtgaaatgcgtagatatatggaggaacaccagtggcgaaggcgactttctggtctgtaactgacgctgaggctcgaaagcatggggagcaaacagg

SEQ ID NO: 995 - DNA, 253 bp, Granulicatella sp.
  Bacilli; Carnobacteriaceae; Granulicatella
tacggaggtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacagg

SEQ ID NO: 996 - DNA, 253 bp, Vagococcus sp.
  Bacilli; Enterococcaceae; Vagococcus
tacgtaggtggcaagcgttgtccggatttattgggcgtaaagcgagcgcaggcggtttcttaagtctgatgtgaaagcccccgacttaaccggggagggtcattggaaactgaggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacagg

SEQ ID NO: 997 - DNA, 253 bp, Unknown
  Description of Unknown: bacterium polynucleotide
  Bacilli; Gemellaceae
tacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacagg

SEQ ID NO: 998 - DNA, 253 bp, Unknown
  Description of Unknown: bacterium polynucleotide
  Bacilli; Lactobacillaceae
tacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacagg

SEQ ID NO: 999 - DNA, 253 bp, Lactobacillus sp.
  Bacilli; Lactobacillaceae; Lactobacillus
tacgtaggtggcaagcgttatccggaattattgggcgtaaagcgagcgcaggcggaaaaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacagg

SEQ ID NO: 1000 - DNA, 253 bp, Lactobacillus sp.
  Bacilli; Lactobacillaceae; Lactobacillus
tacgtaggtggcaagcgttgtccggaattattgggcgtaaagggaacgcaggcggtcttttaagtctgatgtgaaagccttcggcttaaccggagtagtgcattggaaactggaagacttgagtgcagaagaggagggtggaactccatgtgtagcggtgaaatgcgtaggtatatggaagaacaccagtggcgaaagcggctctctggtctgtaactgacgctgaggttcgaaagcgtgggtagcaaacagg

SEQ ID NO: 1001 - DNA, 253 bp, Lactobacillus delbrueckii
  Bacilli; Lactobacillaceae; Lactobacillus delbrueckii
tacgtaggtggcaagcgttgtccggatttattgggcgtaaagcgagcgcaggaggaatgataagtctgatgtgaaagcccacggctcaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacagg

SEQ ID NO: 1002 - DNA, 253 bp, Lactobacillus sp.
  Bacilli; Lactobacillaceae; Lactobacillus
tacgtaggtggcaagcgttgtccggatttattgggcgtaaagcgagcgcaggcggattgataagtctgatgtgaaagccttcggctcaaccgaagaactgcatcagaaactgtcaatcttgagtgcagaagaggagagtggaactccatgtgtagcggtggaatgcgtagatatatggaagaacaccagtggcgaaggcggctctctggtctgtaactgacgctgaggctcgaaagcatgggtagcgaacagg

SEQ ID NO: 1003 - DNA, 253 bp, Lactobacillus sp.
  Bacilli; Lactobacillaceae; Lactobacillus
tacggagggtgcaagcgttgtccggatttattgggcgtaaagcgcgtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacagg

SEQ ID NO: 1004 - DNA, 253 bp, Lactobacillus iners
  Bacilli; Lactobacillaceae; Lactobacillus iners
tacgtaggtggcaagcgttgtccggatttattgggcgtaaagcgagtgcaggcggctcgataagtctgatgtgaaagccttcggctcaaccggagaattgcatcagaaactgtcgagctcgagtacagaagaggagagtggaactccatgtgtagcggtgaaatgcgtagatatatggaagaacaccggtggcgaaggcggctctctggtctgttactgacgctgaggctcgaaggcatgggtagcgaacagg

SEQ ID NO: 1005 - DNA, 253 bp, Lactobacillus reuteri
  Bacilli; Lactobacillaceae; Lactobacillus reuteri
tacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacagg

SEQ ID NO: 1006 - DNA, 253 bp, Lactobacillus brevis
  Bacilli; Lactobacillaceae; Lactobacillus brevis
tacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacagg

SEQ ID NO: 1007 - DNA, 253 bp, Lactobacillus agilis
  Bacilli; Lactobacillaceae; Lactobacillus agilis
tacgtaggtggcaagcgttgtccggatttattgggcgtaaagggaacgcaggcggttttttaagtctgatgtgaaagccttcggcttaaccgaagtcatgcattggaaactgaaagacttgagtgcagaagaggagagtggaactccatgtgtagcggtgaaatgcgtagatatatggaagaacaccagtggcgaaagcggctctctggtctgtaactgacgctgaggttcgaaagtgtgggtagcaaacagg

SEQ ID NO: 1008 - DNA, 253 bp, Lactobacillus paralimentarius
  Bacilli; Lactobacillaceae; Lactobacillus paralimentarius
tacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacagg

SEQ ID NO: 1009 - DNA, 253 bp, Pediococcus sp.
  Bacilli; Lactobacillaceae; Pediococcus
tacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacagg

SEQ ID NO: 1010 - DNA, 253 bp, Unknown
  Description of Unknown: bacterium polynucleotide
  Bacilli; Leuconostocaceae
tacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacagg

SEQ ID NO: 1011 - DNA, 253 bp, Leuconostoc sp.
  Bacilli; Leuconostocaceae; Leuconostoc
tacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacagg

SEQ ID NO: 1012 - DNA, 253 bp, Leuconostoc sp.
  Bacilli; Leuconostocaceae; Leuconostoc
tacgtatgtcccgagcgttatccggatttattgggcgtaaagcgagcgcagacggttggttaagcctgatgtgaaagcccggagctcaactccggaatggcattggaaactggctaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacagg

SEQ ID NO: 1013 - DNA, 253 bp, Weissella ghanensis
  Bacilli; Leuconostocaceae; Weissella ghanensis
tacgtatgtcccaagcgttatccggatttattgggcgtaaagcgagcgcaggcggttatttaagtctgatgtgaaagcctacggctcaaccgtagaattgcatcggaaactggatgacttgagtgcagtagaggagagtggaactccatgtgtagcggtgaaatgcgtagatatatggaagaacaccagaggcgaaggcggctctctggactgtaactgacgctgaggctcgaaagtgtgggtagcaaacagg

SEQ ID NO: 1014 - DNA, 253 bp, Brochothrix sp.
  Bacilli; Listeriaceae; Brochothrix
tacgtaggtggcaagcgttgtccggaattattgggcgtaaagcgcgcgcaggcggtctcttaagtctgatgtgaaagcccccggctcaaccggggagggtcattggaaactgggagacttgaggacagaagaggagagtggaattccaagtgtagcggtgaaatgcgtagatatttggaggaacaccagtggcgaaggcgactcactggcccgatactgacgctgaggcgcgaaagcgtggggagcaaacagg

SEQ ID NO: 1015 - DNA, 252 bp, Unknown
  Description of Unknown: bacterium polynucleotide
  Bacilli; Paenibacillaceae
tacgtagggggcaagcgttgtccggaattattgggcgtaaagcgcgcgcaggcggttctttaagtcttgtgtttaagcccggggctcaaccccggtacgcatgggaaactggaggactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacagg

SEQ ID NO: 1016 - DNA, 252 bp, Unknown
  Description of Unknown: bacterium polynucleotide
  Bacilli; Paenibacillaceae
tacgtagggggcaagcgttgtccggaattattgggcgtaaagcgcgcgcaggcggtcctttaagtcttgtgtttaatcccagagctcaactctggtacgcatgggaaactgggggactggagtgcaggagagggaagtggaattccacgtgtagcggtgaaatgcgtagagatgtggaggaacaccagtggcgaaggcgactttctggcctgtaactgacgctgaggcgcgaaagcgtggggagcaaacagg

SEQ ID NO: 1017 - DNA, 252 bp, Unknown
  Description of Unknown: bacterium polynucleotide
  Bacilli; Paenibacillaceae
tacgtagggggcaagcgttgtccggaattattgggcgtaaagcgcgcgcaggcggctgattaagtctggagtttaagcccggggctcaaccccggatcgctctggaaactggtcggcttgagtgcaggagagggaagcggaattccacgtgtagcggtgaaatgcgtagagatgtggaggaacaccagtggcgaaggcggcttcctggcctgtaactgacgctgaggcgcgaaagcgtggggagcaaacagg

SEQ ID NO: 1018 - DNA, 252 bp, Unknown
  Description of Unknown: bacterium polynucleotide
  Bacilli; Paenibacillaceae
tacgtagggggcaagcgttgtccggaattattgggcgtaaagcgcgcgcaggcggtttcttaagtcttgtgtttaatcccggggctcaacctcggttcgcatgggaaactgggaaactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacagg

SEQ ID NO: 1019 - DNA, 253 bp, Ammoniphilus sp.
  Bacilli; Paenibacillaceae; Ammoniphilus
tacgtagggggcaagcgttgtccggaattattgggcgtaaagcgcgcgcaggcggtttattaagtctgatgtgaaagcccacggctcaaccgtggagggccattggaaactggtaggcttgagtgcaggagaggagagcggaattcccggtgtagcggtgaaatgcgtagatatcgggaggaacacccgtggcgaaggcggctctctggcctgtaactgacgctgaggcgcgaaagcgtggggagcaaacagg

SEQ ID NO: 1020 - DNA, 253 bp, Aneurinibacillus sp.
  Bacilli; Paenibacillaceae; Aneurinibacillus
tacgtagggggcaagcgttgtccggaattattgggcgtaaagcgcgcgcaggcggcttcttaagtcaggtgtgaaagcccacggctcaaccgtggagggccacttgaaactgggaggcttgagtgcaggagaggagagcggaattccacgtgtagcggtgaaatgcgtagagatgtggaggaacacctgtggcgaaggcggctctctggcctgtaactgacgctgaggcgcgaaagcgtggggagcgaacagg

SEQ ID NO: 1021 - DNA, 252 bp, Brevibacillus sp.
  Bacilli; Paenibacillaceae; Brevibacillus
tacgtaggtggcaagcgttgtccggaattattgggcgtaaagcgcgcgcaggcggctatgtaagtctggtgttaaagcccggggctcaaccccggttcgcattggaaactgcgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacagg

SEQ ID NO: 1022 - DNA, 252 bp, Cohnella sp.
  Bacilli; Paenibacillaceae; Cohnella
tacgtagggggcaagcgttgtccggaattattgggcgtaaagcgcgcgcaggcggtttcttaagtctggtgtctaagtgcggggctcaaccccgtgatgcactggaaactgggagacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacagg

SEQ ID NO: 1023 - DNA, 252 bp, Paenibacillus sp.
  Bacilli; Paenibacillaceae; Paenibacillus
tacgtagggggcaagcgttgtccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 1024 - DNA, 252 bp, Paenibacillus sp.
  Bacilli; Paenibacillaceae; Paenibacillus
tacgtagggggcaagcgttgtccggaattattgggcgtaaagcgcgcgcaggcggctttttaagtccggtgtcacagcccaaggctcaaccttgggtcgcactggaaactggagagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1025 - DNA, 252 bp, Paenibacillus sp.
  Bacilli; Paenibacillaceae; Paenibacillus
tacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1026 - DNA, 252 bp, Paenibacillus sp.
  Bacilli; Paenibacillaceae; Paenibacillus
tacgtagggggcaagcgttgtccggaattattgggcgtaaagcgcgcgcaggcggctctttaagtctggtgtttaatcccgaggctcaacttcggatcgcactggaaactggggagcttgagtccagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 1027 - DNA, 252 bp, Paenibacillus chondroitinus
  Bacilli; Paenibacillaceae; Paenibacillus chondroitinus
tacgtagggggcaagcgttgtccggaattattggacgtaaagcgcgcgcaggcggttaattaagttgggtgtttaagcccggggcacaaccccggttcgcatccaaaactggttgacttgagtgtaggagagggaagtggaattccacgtgtagcggtgaaattcgtagatattcgcaagaacaccagtggcgaaggcgacatactggctcattactgacgctgaggctcgaaagcgtggggagcaaacagg

SEQ ID NO: 1028 - DNA, 252 bp, Paenibacillus sp.
  Bacilli; Paenibacillaceae; Paenibacillus
tacgtagggggcaagcgttgtccggaattattgggcgtaaagcgcgcgcaggcggttatttaagtttggtgtttaagcccggggctcaaccccggatcgcactgaaaactggatgacttgagtgcgggagaggaaagtggaattccacgtgtagcggtgaaatgcgtagagatgtggaggaacaccagtggcgaaggcgactttctggaccgtaactgacgctgaggcgcgaaagcgtggggagcaaacagg

SEQ ID NO: 1029 - DNA, 252 bp, Paenibacillus sp.
  Bacilli; Paenibacillaceae; Paenibacillus
tacgtagggggcaagcgttgtccggaattattgggcgtaaagcgcgcgcaggcggccttgtaagtctgtcgtttaaactcggagctcaacttcgagtcgcgatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1030 - DNA, 252 bp, Paenibacillus sp.
  Bacilli; Paenibacillaceae; Paenibacillus
tacgtagggggcaagcgttgtccggaattattgggcgtaaagcgcgcgcaggcggtcatttaagtctggtgtttaatcccgaagctcaacttcgggtcgcatcggaaactgggtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 1031 - DNA, 252 bp, Paenibacillus sp.
  Bacilli; Paenibacillaceae; Paenibacillus
tacgtagggggcaagcgttgtccggaattattgggcgtaaagcgcgcgcaggcggccttgtaagtctagtgtttaatctcgaagctcaacttcgattcgcactggaaactgcaaagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1032 - DNA, 251 bp, Paenibacillus sp.
  Bacilli; Paenibacillaceae; Paenibacillus
gacgggggggcaagcgttgtccgggattattgggcgtaaagcgcgcgcaggcggtcatttaagtctggtgtttaatcccggggctcaaccccggatcgcactggaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 1033 - DNA, 252 bp, Paenibacillus sp.
  Bacilli; Paenibacillaceae; Paenibacillus
tacgtagggggcaagcgttgtccggaattattgggcgtaaagcgcgcgcaggcggttcattaagtctggtgtctaaggctggggctcaaccccggttcgcactggaaactggtgaacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1034 - DNA, 252 bp, Paenibacillus sp.
  Bacilli; Paenibacillaceae; Paenibacillus
tacgtagggggcaagcgttgtccggaattattgggcgtaaagcgcgcgcaggcggtcatttaagtctggtgtataaaccaagggctcaacctttggacgcattggaaactgggtgactggagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 1035 - DNA, 252 bp, Paenibacillus sp.
  Bacilli; Paenibacillaceae; Paenibacillus
tacgtagggggcaagcgttgtccggaattattgggcgtaaagcgcgcgcaggcggctttttaagtccggtgtcacagcccaaggctcagccttgggtcgcactggaaactggagagcttgagtacagaagaggaaagtggaattccacgtgtagcggtgaaatgcgtagagatgtggaggaccaccagtggcgaaggcgactttctgccccgtttcttacgctgaggcgcgaaagcgtggggagcaaacagg

SEQ ID NO: 1036 - DNA, 252 bp, Paenibacillus sp.
  Bacilli; Paenibacillaceae; Paenibacillus
tacgtagggggcaagcgttgtccggaattattgggcgtaaagcgcgcgcaggcggccgcttaagtttggtgtataagcccggggctcaaccccggatcgcaccgaaaactgggtggcttgagtgcaggagaggaaagcggaattccacgtgtagcggtgaaatgcgtagagatgtggaggaacaccagtggcgaaggcggctttctggactgtaactgacgctgaggcgcgaaagcgtggggagcaaacagg

SEQ ID NO: 1037 - DNA, 252 bp, Paenibacillus sp.
  Bacilli; Paenibacillaceae; Paenibacillus
tgcgtagggggcaagcgttgtccggaattattgggcgtaaagcgcgcgcaggcggtcaattaagtctggtgtttaaggctgtggctcaaccacagttcgcactggaaactggttgacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1038 - DNA, 252 bp, Paenibacillus sp.
  Bacilli; Paenibacillaceae; Paenibacillus
tacgtagggggcaagcgttgtccggaattattgggcgtaaagcgcgcgcaggcggccatttaagtctggtgtttaatcccggggctcaaccccgggtcgcatcggaaactgggtggctggagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1039 - DNA, 252 bp, Paenibacillus hodogayensis
  Bacilli; Paenibacillaceae; Paenibacillus hodogayensis
tacgtagggggcaagcgttgtccggaattattgggcgtaaagcgcgcgcaggcggctgtttaagtctggtgtttaagcccggggctcaaccccggttcgcaccggaaactggacggcttgagtgcaggagagggaagtggaattccacgtgtagcggtgaaatgcgtagagatgtggaggaacaccagtggcgaaggcgacttcctggcctgtaactgacgctgaggcgcgaaagcgtggggagcaaacagg

SEQ ID NO: 1040 - DNA, 252 bp, Saccharibacillus kuerlensis
  Bacilli; Paenibacillaceae; Saccharibacillus kuerlensis
tacgtagggggcaagcgttgtccggaattattgggcgtaaagcgcgtgcaggcggcggtttaagtcggatgtttaagatcggggctcaaccccgattcgcatccgaaactgggccgcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 1041 - DNA, 252 bp, Saccharibacillus kuerlensis
  Bacilli; Paenibacillaceae; Saccharibacillus kuerlensis
tacgtagggggcaagcgttgtccggaattattgggcgtaaagcgcgtgcaggcggcttgttaagtcggatgtttaagatcggggctcaaccccgattcgcatccgaaactggcaagcttgagtgtaggagagggaagtggaattccacgtgtagcggtgaaatgcgtagagatgtggaggaacaccggtggcgaaggcgactttctggcctataactgacactgaggcgcgaaagcgtggggagcaaacagg

SEQ ID NO: 1042 - DNA, 253 bp, Bacillus thermoalkalophilus
  Bacilli; Planococcaceae; Bacillus thermoalkalophilus
tacgtaggtggcaagcgttgtccggaattattgggcgtaaagcgcgcgcaggcggttccttaagtctgatgtgaaatctcgcggctcaaccgcgagcggccattggaaactggggaacttgagtgcaggagaggggagcggaattccacgtgtagcggtgaaatgcgtagagatgtggaggaacaccagtggcgaaggcggctctctggcctgtaactgacgctgaggcgcgaaagcgtggggagcgaacagg

SEQ ID NO: 1043 - DNA, 253 bp, Lysinibacillus massiliensis
  Bacilli; Planococcaceae; Lysinibacillus massiliensis
tacgtagggtgcgagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacagg

SEQ ID NO: 1044 - DNA, 253 bp, Solibacillus sp.
  Bacilli; Planococcaceae; Solibacillus
tacgtaggtggcaagcgttgtccggaattattgggcgtaaagcgcgcgcaggtggttctttaagtctgatgtgaaagcccccggctcaaccggggagggtcattggaaactggggaacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacagg

SEQ ID NO: 1045 - DNA, 253 bp, Sporosarcina sp.
  Bacilli; Planococcaceae; Sporosarcina
tacgtaggtggcaagcgttgtccggaattattgggcgtaaagcgcgcgcaggcggccttttaagtctgatgtgaaagcccacggcttaaccgtggaaggtcattggaaactgaaaggcttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 1046 - DNA, 253 bp, Sporosarcina ginsengi
  Bacilli; Planococcaceae; Sporosarcina ginsengi
tacgtagggggcgagcgttatccggaattattgggcgtaaagcgcgcgcaggcggtcctttaagtctgatgtgaaagcccacggctcaaccgtggagggtcattggaaactgggggacttgagtacagaagggaagagtggaattccacgtgtagcggtgaaatgcgtagggatgtggaggaacaccagtggcgaaggcggctttctggtctgtaactgacgctgaggcgcgaaagcgtggggagcaaacagg

SEQ ID NO: 1047 - DNA, 253 bp, Bacillus racemilacticus
  Bacilli; Sporolactobacillaceae; Bacillus racemilacticus
tacgtaggtggcaagcgttgtccggaattattgggcgtaaagcgcgcgcaggcggtttcttaagtctgatgtgaaagcccccagctcaactggggagggtcattggaaactgggaaacttgagtacagaagaggagagtagaattccacgtgtagcggtgaaatgcgtagagatgtggaggaataccagtggcgaaggcggctctctggtctgtaactgacgctgaggcgcgaaagcgtggggagcaaacagg

SEQ ID NO: 1048 - DNA, 253 bp, Sporolactobacillus sp.
  Bacilli; Sporolactobacillaceae; Sporolactobacillus
tacgtaggtggcaagcgttgtccggaattattgggcgtaaagcgcgcgcaggcggcaccttaagtctgatgtgaaatcttgcggctcaaccgcaagcggtcattggaaactggggcgcttgagtgcagaagaggagagcagaattccacgtgtagcggtgaaatgcgtagagatgtggaggaataccggtggcgaaggcggctctctggtctgttactgacgctgaggtgcgaaagcgtggggagcgaacagg

SEQ ID NO: 1049 - DNA, 253 bp, Sporolactobacillus sp.
  Bacilli; Sporolactobacillaceae; Sporolactobacillus
tacgtaggtggcaagcgttgtccggaattattgggcgtaaagggcgcgcaggcggttttctaagtctgatgtgaaatcttgcggctcaaccgcaagcggtcattggaaactggggaacttgagtgcagaagaggagagtagaattccacgtgtagcggtgaaatgcgtagagatgtggaggaataccggtggcgaaggcggctctctggtctgtaactgacgctgaggtgcgaaagcgtggggagcaaacagg

SEQ ID NO: 1050 - DNA, 253 bp, Unknown
  Description of Unknown: bacterium polynucleotide
  Bacilli; Staphylococcaceae
tacgtagggggcgagcgttgtccggaattattgggcgtaaagggcgcgcaggcggtttcttaagtctgatgtgaaatctcgtggcttaaccacgagcggtcgttggaaactgggaaacttgagtacagaagaggagagtggaattccacgtgtagcggtgaaatgcgtagagatgtggaggaacaccagtggcgaaggcggctctctggtctgtaactgacgctgaggtgcgaaagcgtggggagcaaacagg

SEQ ID NO: 1051 - DNA, 253 bp, Jeotgalicoccus sp.
  Bacilli; Staphylococcaceae; Jeotgalicoccus
tacgtaggtggcaagcgttatccggaattattgggcgtaaagcgcgcgtaggcggcaagaaaagtctgatgtgaaagcccccggctcaaccggggagggtcattggaaactgttttgcttgagtacagaagaggagagtggaattccatgtgtagcggtgaaatgcgcagagatatggaggaacaccagtggcgaaggcggctctctggtctgtaactgacgctgatgtgcgaaagcgtggggatcaaacagg

SEQ ID NO: 1052 - DNA, 253 bp, Jeotgalicoccus sp.
  Bacilli; Staphylococcaceae; Jeotgalicoccus
tacgtaggtggcaagcgttatccggaattattgggcgtaaagcgcgcgtaggcggtagaataagtctgatgtgaaagcccctggctcaaccagggagggtcattggaaactgttttacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacagg

SEQ ID NO: 1053 - DNA, 253 bp, Salinicoccus sp.
  Bacilli; Staphylococcaceae; Salinicoccus
tacgtaggtggcaagcgttatccggaattattgggcgtaaagcgcgcgtaggcggtcttttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgatgcgcgaaagcgtggggatcaaacagg

SEQ ID NO: 1054 - DNA, 253 bp, Staphylococcus sciuri
  Bacilli; Staphylococcaceae; Staphylococcus sciuri
tacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggagagtggaatcccatgtgtagcggtgaaatgcgcagagatatggaggaacaccagtggcgaaggcggctctctggtctgtaactgacgctgatatgcgaaagcgtgaggatcaaacagg

SEQ ID NO: 1055 - DNA, 253 bp, Staphylococcus sciuri
  Bacilli; Staphylococcaceae; Staphylococcus sciuri
tacgtaggtggcaagcgttatccggaattattgggcgtaaagcgcgcgtaggcggttccttaagtctgatgtgaaagcccacggctcaaccgtggagggtcattggaaactggggaacttgagtgcaggagaggagagtggaattccatgtgtggcggtgaaatacgcagagatatggaggaacaccagtggcgaaggcggctctctggtctgtaactgacgctgatgtgcgaaagcgtggggatcaaacagg

SEQ ID NO: 1056 - DNA, 252 bp, Lactococcus sp.
  Bacilli; Streptococcaceae; Lactococcus
tacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacagg

SEQ ID NO: 1057 - DNA, 252 bp, Lactococcus sp.
  Bacilli; Streptococcaceae; Lactococcus
tacgtaggtcccgagcgttgtccggatttattgggcgtaaagcgagcgcaggtggtttaataagtctgatgtaaaaggcagtggctcaaccattgtgtgcattggaaactgttagacttgagtgcagtagaggagagtggaattccatgtgtagcggtgaaatgcgtagatatatggaggaacaccggtggcgaaagcggctctctggactgtcactgacactgaggctcgaaagcgtgggtagcaaacagg

SEQ ID NO: 1058 - DNA, 252 bp, Streptococcus sp.
  Bacilli; Streptococcaceae; Streptococcus
tacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacagg

SEQ ID NO: 1059 - DNA, 252 bp, Streptococcus sp.
  Bacilli; Streptococcaceae; Streptococcus
tacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacagg

SEQ ID NO: 1060 - DNA, 251 bp, Streptococcus sp.
  Bacilli; Streptococcaceae; Streptococcus
tacgtaggtcccgagcgttgtccggatttattgggcgtgaagcgagcgcaggcggttagataagtctgaagttaaaggctgtggcttaaccatagtatgctttggaaactgtttaacttgagtgcagaaggggagagtggaattccatgtgtagcggtgaaatgcgtagatatatagtggaacaccggtggcgaaagcggctctctgtctgtaactgacgctgaggctcgaaagcgtggggagcaaacagg

SEQ ID NO: 1061 - DNA, 252 bp, Streptococcus luteciae
  Bacilli; Streptococcaceae; Streptococcus luteciae
tacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcatggggagcaaacagg

SEQ ID NO: 1062 - DNA, 252 bp, Streptococcus sp.
  Bacilli; Streptococcaceae; Streptococcus
tacgtaggtcccgagcgttgtccggatttattgggcgtaaagcgagcgcaggcggtttcttaagtctggagtaaaaggcagtggcttaaccattgtacgctctggaaactggggaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacagg

SEQ ID NO: 1063 - DNA, 252 bp, Streptococcus sobrinus
  Bacilli; Streptococcaceae; Streptococcus sobrinus
tacgtaggtcccgagcgttgtccggatttattgggcgtaaagggagcgcaggcggtttagtaagtctgaagttaaaggcattggctcaaccaatgtatgctttggaaactgttagacttgagtgcagaaggggagagtggaattccatgtgtagcggtgaaatgcgtagatatatggaggaacaccggtggcgaaagcggctctctggtctgtcactgacgctgaggctcgaaagcgtgggtagcgaacagg

SEQ ID NO: 1064 - DNA, 253 bp, Unknown
  Description of Unknown: bacterium polynucleotide
  Bacilli; Thermoactinomycetaceae
tacgtagggggcaagcgttgtccggaattattgggcgtaaagcgcgcgcaggcggcctgttaagtctggtgtgaaagaccacggctcaaccgtggggtggcatcagaaactggcgggcttgagtgcaggagaggagagtggaattcccggtgtagcggtggaatgcgtagagatcgggaggaacaccagtggcgaaggcgactctctggcctgtaactgacgctgaggcgcgaaagcgtggggagcgaacagg

SEQ ID NO: 1065 - DNA, 253 bp, Thermoactinomyces sp.
  Bacilli; Thermoactinomycetaceae; Thermoactinomyces
tacgtagggggcgagcgttatccggaattattgggcgtaaagcgcgcgcaggcggctgattaagtcaggtgtgaaaggctgcggctcaaccgcagagcggcacctgaaactggtcagcttgagtgcagaagaggggagcggaattcccggtgtagcggtggaatgcgtagagatcgggaggaacaccagtggcgaaggcggctctctggcctgtaactgacgctgaggcgcgaaagcgtggggagcaaacagg

SEQ ID NO: 1066 - DNA, 253 bp, Unknown
  Description of Unknown: bacterium polynucleotide
  Bacteroidia
tacggaggatccgagcgttatccggatttattgggtttaaagggtgcgcaggcgggtatgtaagtcagaggtgaaattctacggctcaactgtagaactgcctttgatactgcaaatctagagtatatttggagtgggcggaatgtagcatgtagcggtgaaatgcttagatatgctacagaacaccgatcgtgaagacagctcactaaactataactgacgctcaggcacgaaagcgtggggagcaaacagg

SEQ ID NO: 1067 - DNA, 253 bp, Unknown
  Description of Unknown: bacterium polynucleotide
  Bacteroidia
tacagaggatgcaagcgttatccggatttattgggtttaaagggtgcgtaggcggcgttgtaagtcagtggtgaaagttttcagcttaactggaaaattgccattgatactgcagtgcttgagtacagatgaggtgggcggaatgtgtcatgtagcggtgaaatgcatagatatgacacagaacaccgattgcgaaggcagctcactaaactgtaactgacgctgaggcacgaaagcgtggggatcaaacagg

SEQ ID NO: 1068 - DNA, 253 bp, Unknown
  Description of Unknown: bacterium polynucleotide
  Bacteroidia
tacggaggattcgagcgttatccggatttactgggtttaaagggtgcgcaggcgggctcttaagtcagcggtgaaatgtctgggcttaccctaggaattgccgttgatactgggagtcttggataagcataaggacggcggaatgcgtagtgtagcggtgaaatgcttagatattacgtagaagaccaattgcgaaggcagctgtctgggtctttatcgacgctcaagcacgaaagcgtggggagcaaacagg

SEQ ID NO: 1069 - DNA, 252 bp, Prevotella sp.
  Bacteroidia; Paraprevotellaceae; Prevotella
tacggaaggtccaggcgttatccggatttattgggtttaaagggagcgtaggcggattattaagtcagtggtgaaagacggtggctcaaccatcgttagccattgaaactggtagtcttgggtgcagacagggatgctggaactcgtggtgtagcggtgaaatgcttagatatcacgatgaactccgatcgcgaaggcaggtgtccgggctgcaactgacgctgaggctcgaaagtgtgggtatcaaacagg

SEQ ID NO: 1070 - DNA, 253 bp, Prevotella sp.
  Bacteroidia; Paraprevotellaceae; Prevotella
tacggaaggtccgggcgttatccggatttattgggtttaaagggagcgtaggtggactgtcaagtcagttgtgaaatccgcgggctcaacctgcggcctgcagttgaaactggcggtcttgagtccgttcagggatgctggaattcatggtgtagcggtgaaatgctcagatatcatgaagaactccaatcgcgaaggcaggcatccgggccggaactgacactgaggctcgaaagtgcgggtatcaaacagg

SEQ ID NO: 1071 - DNA, 253 bp, Prevotella sp.
  Bacteroidia; Paraprevotellaceae; Prevotella
tacggaaggtccaggcgttatccggatttattgggtttaaagggagcgcaggcggactcttaagtcagttgtgaaatacggcggctcaaccgtcggactgcagttgatactgggagtcttgagtgcacacagggatgctggaattcatggtgtagcggtgaaatgctcagatatcatgaagaactccgatcgcgaaggcaggtatccggggtgcaactgacgctgaggctcgaaagtgcgggtatcaaacagg

SEQ ID NO: 1072 - DNA, 253 bp, Unknown
  Description of Unknown: bacterium polynucleotide
  Bacteroidia; Bacteroidaceae
tacggaggatgcgagcgttatccggatttattgggtttaaagggtgcgtaggcggtttgttaagtcagtggtgaaagttttcggctcaaccggaaaattgccattgaaactgacagacttgagtgtaaacgaggtaggcggaattcgtggtgtagcggtgaaatgcttagatatcacgaagaactccaattgcgaaggcagcttactaggctacaactgacgctgaagcacgaaagcgtggggatcaaacagg

SEQ ID NO: 1073 - DNA, 253 bp, Bacteroides ovatus
  Bacteroidia; Bacteroidaceae; Bacteroides ovatus
tacggaggatccgagcgttatccggatttattgggtttaaggggagcgtagatggatgtttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacagg

SEQ ID NO: 1074 - DNA, 253 bp, Bacteroides fragilis
  Bacteroidia; Bacteroidaceae; Bacteroides fragilis
tacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacagg

SEQ ID NO: 1075 - DNA, 255 bp, Bacteroides sp.
  Bacteroidia; Bacteroidaceae; Bacteroides
tacggaggatgcgagcgttatccggatttattgggtttaaagggagcgtaggtgggttattaagtcagcgttgtgaaagtttgcggctcaaccgtaaaattgccgttgatactgatagtcttgagttcagtagaggtgtgcggaattcgtggtgtagcggtgaaatgcttagatatcacgaagaactccaattgcgaaggcagctcactagactgtaactgacactgatgctcgaaagtgtgggtatcaaacagg

SEQ ID NO: 1076 - DNA, 253 bp, Bacteroides sp.
  Bacteroidia; Bacteroidaceae; Bacteroides
tacgtaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacactgatgctcgaaagtgtgggtatcaaacagg

SEQ ID NO: 1077 - DNA, 253 bp, Bacteroides sp.
  Bacteroidia; Bacteroidaceae; Bacteroides
tacggaggatccgagcgttatccggatttattgggtttaaagggagcgtaggcggattattaagtcagttgtgaaagtttgcggctcaaccgtaaaattgcagttgatactggtagtcttgagtgcagtagaggtaagcggaattcgtggtgtagcggtgaaatgcttagatatcacgaagaactccaattgcgaaggcagcttgctggactgtaactgacgctgatgctcgaaagtgtgggtatcaaacagg

SEQ ID NO: 1078 - DNA, 253 bp, Ruminofilibacter xylanolyticum
  Bacteroidia; Marinilabiaceae; Ruminofilibacter xylanolyticum
tacggaggatgcaagcgttatccggatttattgggtttaaagggtgcgtaggcgggactgtaagtcaggggtgaaatactgcagcttaactgtagcattgcctttgaaactgccgttcttgagtgcagttgaggtaggcggaatgtggtgtgtagcggtgaaatgcatagatataccacagaacgccgattgcgaaggcagcttactaagctgttactgacgctgaggcacgaaagcgtggggatcaaacagg

SEQ ID NO: 1079 - DNA, 253 bp, Unknown
  Description of Unknown: bacterium polynucleotide
  Bacteroidia; Porphyromonadaceae
tacggaggatccgagcgttatccggatttattgggtttaaagggtgcgcaggcggcatgttaagtcggcggtgaaattttgcagctcaactgtaaaagagccttcgaaactggcaagcttgagtgtggatgaagtaggcggaatttgtggtgtagcggtgaaatgcatagatatcacaaagaacaccgattgcgcaggcagcttactaaaccataactgacgctcatgcacgaaggcgtggggatcaaacagg

SEQ ID NO: 1080 - DNA, 253 bp, Dysgonomonas sp.
  Bacteroidia; Porphyromonadaceae; Dysgonomonas
tacgggggatgcgagcgttatccggatttattgggtttaaagggtgcgtaggcgggataataagtcagcggtgaaagtttgaggctcaaccttaaaattgccgttgaaactgtttttcttgagtatatttgaagtaggcggaattcgtggtgtagcggtgaaatgcatagatatcacgaagaactccaattgcgaaggcagcttactaaactataactgacgctgaagcacgagagcgtgggtatcaaacagg

SEQ ID NO: 1081 - DNA, 253 bp, Parabacteroides sp.
  Bacteroidia; Porphyromonadaceae; Parabacteroides
tacggaggatgcgagcgttatccggatttattgggtttaaagggtgcgtaggtggtgatttaagtcagcggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccataactgacactgaagcacgaaagcgtggggatcaaacagg

SEQ ID NO: 1082 - DNA, 253 bp, Porphyromonas sp.
  Bacteroidia; Porphyromonadaceae; Porphyromonas
tacggaggatgcgagcgttatccggatttattgggtttaaagggtgcgtaggcggcctgttaagtcagcggtgaaatctaggagcttaactcctaaattgccattgaaactggcgggcttgagtgtagatgaggtaggcggaatgcgtggtgtagcggtggaatgcatagatatcacgcagaactccaattgcgaaggcagcttactaaggtacaactgacgctgaagcacgaaagcgtgggtatcaaacagg

SEQ ID NO: 1083 - DNA, 253 bp, Porphyromonas sp.
  Bacteroidia; Porphyromonadaceae; Porphyromonas
tacggaggatgcgagcgttatccggatttattgggtttaaagggtgcgtaggttgttcggtaagtcagcggtgaaaactgagcgctcaacgttcagcgtgccgttgaaactgccgggcttgagttcagtggcggcaggcggaattcgtggtgtagcggtgaaatgcatagatatcacgaggaactccgattgcgaaggcagcttgccatactgcgactgacactgaagcacgaaggcgtgggtatcaaacagg

SEQ ID NO: 1084 - DNA, 253 bp, Porphyromonas sp.
  Bacteroidia; Porphyromonadaceae; Porphyromonas
tacggaggatacgagcgttatccggatttattgggtttaaagggtgcgtaggtggcttcataagtcagtggtgaaaagctgtggctcaaccatagtcttgccgttgaaactgtggagcttgagtgcggatgaggtaggcggaacgcgtagtgtagcggtgaaatgcatagatattacgcagaactccgattgcgaaggcagcttaccaaaccgcaactgacactgaagcacgaaagcgtgggtatcaaacagg

SEQ ID NO: 1085 - DNA, 253 bp, Porphyromonas sp.
  Bacteroidia; Porphyromonadaceae; Porphyromonas
tacggaggatgcgagcgttatccggaattattgggtttaaagggtgcgtaggttgcaagggaagtcaggggtgaaaagctatagctcaactatggtcttgcctttgaaactctctagctagagtgtactggaggtacgtggaacgtgtggtgtagcggtgaaatgcatagatatcacacagaactccgattgcgcaggcagcgtactacattacaactgacactgaagcacgaaagcgtgggtatccaacagg

SEQ ID NO: 1086 - DNA, 253 bp, Porphyromonas sp.
  Bacteroidia; Porphyromonadaceae; Porphyromonas
tacggaggatgcgagcgttatccggatttattgggtttaaagggtgcgtaggcggtttgttaagtcagcggtgaaatctcagagctcaactctgaaactgccgttgaaactggcgaacttgagtgtagatgaggtaggcggaattcgtggtgtagcggtgaaatgcatagatatcacgaggaactccgattgcgtaggcagcttactaagttacaactgacgctgatgcacgaaagcgtgggtatcaaacagg

SEQ ID NO: 1087 - DNA, 253 bp, Prevotella melaninogenica
  Bacteroidia; Prevotellaceae; Prevotella melaninogenica
tacggaaggtccgggcgttatccggatttattgggtttaaagggagcgtaggctggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgcaactgacgctgaagctcgaaggtgcgggtatcgaacagg

SEQ ID NO: 1088 - DNA, 253 bp, Prevotella copri
  Bacteroidia; Prevotellaceae; Prevotella copri
tacggaaggtccgggcgttatccggatttattgggtttaaagggagcgtaggccggagattaagcgtgttgtgaaatgtagatgctcaacatctgaactgcagcgcgaactggtttccttgagtacgcacaaagtgggcggaattcgtggtgtagcggtgaaatgcttagatatcacgaagaactccgattgcgaaggcagctcactggagcgcaactgacgctgaagctcgaaagtgcgggtatcgaacagg

SEQ ID NO: 1089 - DNA, 253 bp, Prevotella sp.
  Bacteroidia; Prevotellaceae; Prevotella
tacggaaggtccgggcgttatccggatttattgggtttaaagggagtgtaggcggtctgttaagcgtgttgtgaaatgtagatgctcaacatctgaactgcagcgcgaactggctggcttgagtacacgcaacgtgggcggaattcatggtgtagcggtgaaatgcttagatatcatgaggaactcctattgcgaaggcagctcacgggagtgtcactgacgcttaagctcgaaggtgcgggtatcaaacagg

SEQ ID NO: 1090 - DNA, 253 bp, Prevotella sp.
  Bacteroidia; Prevotellaceae; Prevotella
tacggaaggtccgggcgttatccggatttattgggtttaaagggagcgtaggccgccaggtaagcgtgttgtgaaatgtaccggctcaaccggtgaattgcagcgcgaactgtctggcttgagtgcacggtaagcaggcggaattcatggtgtagcggtgaaatgcttagatatcatgaagaactccgattgcgaaggcagcttgctgcagtgcgactgacgctgatgctcgaaggtgcgggtatcaaacagg

SEQ ID NO: 1091 - DNA, 253 bp, Unknown
  Description of Unknown: bacterium polynucleotide
  Bacteroidia; Rikenellaceae
tacggaggattcaagcgttatccggatttattgggtttaaagggtgcgtaggcggtttgataagttagaggtgaaatcccggggcttaactccggaactgcctctaatactgttagactagagagtagttgcggtaggcggaatgtatggtgtagcggtgaaatgcttagagatcatacagaacaccgattgcgaaggcagcttaccaaactatatctgacgttgaggcacgaaagcgtggggagcaaacagg

SEQ ID NO: 1092 - DNA, 252 bp, Unknown
  Description of Unknown: bacterium polynucleotide
  Bacteroidia; S24-7
tacggaggatgcgagcgttatccggatttattgggtttaaagggtgcgtaggcggtccgttaagtcagcggtaaaattgcggggctcaaccccgtcgagccgttgaaactggcagacttgagttggcgagaagtacgcggaatgcgcggtgtagcggtgaaatgcatagatatcgcgcagaactccgattgcgaaggcagcgtaccggcgccacactgacgctgaggcacgaaagcgtggggatcgaacagg

SEQ ID NO: 1093 - DNA, 253 bp, Unknown
  Description of Unknown: bacterium polynucleotide
  BD7-11
gacagaggtggcgaccgttgttcggaatcactgggcataaagcgcgtgtaggcggcattgtaagtcgggtgtgaaatccctcggcctaaccgaggaattgcgctcgaaactactttgcttgaggatcagaggggagcctggaattcctggtggagcggtgaaatgcgttgatatcaggaggaacaccggcggcgaaggcgaggctctggctgatttctgacgctgagacgcgaaagctaggggagcaaacggg

SEQ ID NO: 1094 - DNA, 253 bp, Unknown
  Description of Unknown: bacterium polynucleotide
  BD7-11
gacgaaggtggcaagcgttgttcggaatcactgggcataaagcgcacgtaggcggtggcgtaagtcggatgtgaaatccctcggcctaaccgaggaactgcgcccgatactgcgttgcttgaggaccaaaggggtgcatggaatttccggtggagcggtgaaatgcgtagagatcgggaggaaggccggtggcgaaggcggcgctctggaacatttctgacgctgaggctcgaaagcgtggggagcaaacagg

SEQ ID NO: 1095 - DNA, 253 bp, Unknown
  Description of Unknown: bacterium polynucleotide
  Betaproteobacteria
tacgtagggtgcaagcgttaatcggaattactgggcgtaaagcgtgcgcaggcggttttgtaagccagatgtgaaatccccgggcttaacctgggaatggcatttgggactgcaaggctggagtttggcagaggagactggaattcctggtgtagcagtgaaatgcgtagatatcaggaggaataccgatggcgaaggcaggtctctgggctataactgacgctcatgcacgaaagcgtggggagcaaacagg

SEQ ID NO: 1096 - DNA, 253 bp, Unknown
  Description of Unknown: bacterium polynucleotide
  Betaproteobacteria
tacgtagggtgcgagcgttaatcggaattactgggcgtaaagcgtgcgcaggcggttttgtaagccagatgtgaaagccccgggcttaacctgggaatggcatttgggactgcaaggcttgagtgcggcagaggagactggaattcctggtgtagcagtgaaatgcgtagatatcaggaggaataccgatggcgaaggcaggtctctgggctgacactgacgctcatgcacgaaagcgtggggagcaaacagg

SEQ ID NO: 1097 - DNA, 253 bp, Unknown
  Description of Unknown: bacterium polynucleotide
  Betaproteobacteria
tacgtagggtgcgagcgttaatcggaattactgggcgtaaagtgtgcgcaggcggcagagcaagtcgagtgtgaaagccccgggcttaacttgggaattgcgctcgaaactactttgctggagtgtggcagaggaaggtggaattccacgtgtagcggtgaaatgcgtagagatgtggaggaacaccaatggcgaaggcagccttctgggccaacactgacgctcatgcacgaaagcgtggggagcaaacagg

SEQ ID NO: 1098 - DNA, 253 bp, Unknown
  Description of Unknown: bacterium polynucleotide
  Betaproteobacteria
tacgtagggtgcgagcgttaatcggaattactgggcgtaaagcgagcgcaggcggttctgcaagtcagatgtgaaatccccgggcttaacctgggaattgcatttgtgactgcacgactagagtgtgtcagaggggggtggaattccacgtgtagcagtgaaatgcgtagatatgtggaggaacaccaatggcgaaggcagccccctgggataacactgacgctcatgcacgaaagcgtggggagcaaacagg

SEQ ID NO: 1099 - DNA, 253 bp, Unknown
  Description of Unknown: bacterium polynucleotide
  Betaproteobacteria
tacgtagggtgcaggcgttaatcggaattactgggcgtaaagcgtgcgcaggcggtctattaagacaggtgtgaaatccccgggcttaacctgggaactgcgcttgtaactgataggctggagtgtggcagaggggggtggaattccacgtgtagcagtgaaatgcgtagagatgtggaggaacaccgatggcgaaggcagccccctgggctaacactgacgctcatgcacgaaagcgtggggagcaaacagg

SEQ ID NO: 1100 - DNA, 253 bp, Unknown
  Description of Unknown: bacterium polynucleotide
  Betaproteobacteria
tacgtagggtgcaggcgttaatcggaattactgggcgtaaagcgtgcgcaggcggtctgctaagacaggtgtgaaatccccgggcttaacctgggaactgcgcttgttactggcaggcttgagtgtggcagaggggggtggaattccacgtgtagcagtgaaatgcgtagagacgtgggggaacaccgatggcgaaggcagccccctgggctaacactgacgctcatgcacgaaagcgtggggagcaaacagg

SEQ ID NO: 1101 - DNA, 253 bp, Unknown
  Description of Unknown: bacterium polynucleotide
  Betaproteobacteria
tacgtagggtgcgagcgttaatcggagttactgggcgtaaagcgtgcgcaggcggtccgttgtgtccgatgtgaaagccccgggcttaacctgggaatggcattggaaactggcgggcttgagtgtggcagaggggggtggaattccgcgtgtagcagtgaaatgcgtagagatgcggaggaacaccgatggcgaaggcagccccctgggccaacactgacgctcaggcacgaaagcgtggggagcaaacagg

SEQ ID NO: 1102 - DNA, 253 bp, Unknown
  Description of Unknown: bacterium polynucleotide
  Betaproteobacteria
tacgtagggtgcaagcgttaatcggaattactgggcgtaaagcgtgcgcaggcggtttcgtaagacggatgtgaaatccccgggctcaacctgtgaactgcattcgtgactgcgaggctagagtgtgtcagagggaggtggaattccgcgtgtagcagtgaaatgcgtagagatgcggaggaacaccgatggcgaaggcagcctcctgggataacactgacgctcaggcacgaaagcgtggggagcaaacagg

SEQ ID NO: 1103 - DNA, 253 bp, Unknown
  Description of Unknown: bacterium polynucleotide
  Betaproteobacteria
tacgtagggtgcaggcgttaatcggaattactgggcgtaaagcgtgcgcaggcggtttgttaagacaggtgtgaaatccccgagcttaacttgggaattgcgcttgtaactggcaagctagagtgtggcagaggggggtggaattccacgtgtagcagtgaaatgcgtagatatgtggaggaacaccgatggcgaaggcagccccctgggttaacactgacgctcatgcacgaaagcgtgggtagcaaacagg

SEQ ID NO: 1104 - DNA, 253 bp, Unknown
  Description of Unknown: bacterium polynucleotide
  Betaproteobacteria
tacggagggtgcgagcgttaatcggaattactgggcgtaaagggtgcgcaggcggttttttaagtcagctgtgaaatacctgggcttaacctagggactgcagttgagactggaaggctagagtgtgtcagaggggggtagaattccacgtgtagcagtgaaatgcgtagagatgtggaggaataccgatggcgaaggcagccccctgggataacactgacgctcaagcacgaaagcgtggggagcaaacagg

SEQ ID NO: 1105 - DNA, 253 bp, Unknown
  Description of Unknown: bacterium polynucleotide
  Betaproteobacteria
tacgtagggtgcaagcgttaatcggaattactgggcgtaaagggtgcgcaggcggtctcgccagtcaggcgtgaaatccccgggcttaacctgggaatggcgcttgaaactacgggactggagtatggcagagggaggtggaattccacgtgtagcggtgaaatgcgtagagatgtggaggaacaccgatggcgaaggcagcctcctgggccaatactgacgctcatgcacgaaagcgtggggagcaaacagg

SEQ ID NO: 1106 - DNA, 253 bp, Unknown
  Description of Unknown: bacterium polynucleotide
  Betaproteobacteria
tacgtagggtgcgagcgttaatcggaattactgggcgtaaagtgtgcgcaggcggcgttgcaagtcgagtgtgaaatccccgagcttaacttgggaattgcgctcgaaactacgatgctcgagtatggcagaggaaggtggaattccacgtgtagcggtgaaatgcgtagagatgtggaggaacaccgatggcgaaggcagccttctgggccaatactgacgctcatgcacgaaagcgtggggagcaaacagg

SEQ ID NO: 1107 - DNA, 253 bp, Unknown
  Description of Unknown: bacterium polynucleotide
  Betaproteobacteria
tacagagggtgcaagcgttaatcggaattactgggcgtaaagcgtgcgcaggcggttgtgcaagacagatgtgaaatccccgggctcaacctgggaactgcatttgtgactgcaaggctagagtacggcagaggggggtagaattccacgtgtagcagtgaaatgcgtagatatgtggaggaataccgatggcgaaggcagccccctgggtcgatactgacgctcatgcacgaaagcgtggggatcaaacagg

SEQ ID NO: 1108 - DNA, 253 bp, Unknown
  Description of Unknown: bacterium polynucleotide
  Betaproteobacteria
tacgtagggtgcgagcgttaatcggaattactgggcgtaaagcgtgcgcaggcggcgccgcaagtcaggcgtgaaacccccgagcttaacttgggaatggcgcttgaaactacggtgctggagtgtggcagagggaggtggaattccacgtgtagcggtgaaatgcgtagagatgtggaggaacaccgatggcgaaggcagcctcctgggccgacactgacgctcatgcacgaaagcgtggggagcaaacagg

SEQ ID NO: 1109 - DNA, 253 bp, Unknown
  Description of Unknown: bacterium polynucleotide
  Betaproteobacteria
tacgtagggtgcgagcgttaatcggaattactgggcgtaaagcgtgcgcaggcggtgatttaagtcagatgtgaaagccccgggcttaacctgggaactgcgtttgaaactggatcgctggagtttagcagaggggggtagaattccacgtgtagcagtgaaatgcgtagagatgtggaggaacaccgatggcgaaggcagccccctgggctagaactgacgctcatgcacgaaagcgtggggagcaaacagg

SEQ ID NO: 1110 - DNA, 253 bp, Unknown
  Description of Unknown: bacterium polynucleotide
  Betaproteobacteria
tacgtagggtgcgagcgttaatcggaattactgggcgtaaagcgtgcgcaggcggcgtcgcaagtcaggcgtgaaatccccgggcttaacctgggaatggcgcttgaaactacgatgctggagtatggcagagggaggtggaattccacgtgtagcggtgaaatgcgtagatatgtggaggaacaccgatggcgaaggcagcctcctgggccaatactgacgctcatgcacgaaagcgtggggagcaaacagg

SEQ ID NO: 1111 - DNA, 253 bp, Unknown
  Description of Unknown: bacterium polynucleotide
  Betaproteobacteria
tacgtagggtgcgagcgttaatcggaattactgggcgtaaagcgtgcgcaggcggttcgtcgtgtctggtgtgaaagccccgggcttaacctgggaatggcattggaaactggcgaactggagtgtggcagaggggggtggaattccgcgtgtagcagtgaaatgcgtagagatgcggaggaacaccgatggcgaaggcagccccctgggctgacactgacgctcaggcacgaaagcgtggggagcaaacagg

SEQ ID NO: 1112 - DNA, 253 bp, Unknown
  Description of Unknown: bacterium polynucleotide
  Betaproteobacteria
tacgtagggtgcgagcgttaatcggaattactgggcgtaaagcgtgcgcaggcggttttgtaagccagtcgtgaaatccccgggcttaacctgggaatggcgattgggactgcaaggctggagtatggcagaggagactggaattcctggtgtagcagtgaaatgcgtagatatcaggaggaataccgatggcgaaggcaggtctctgggctgatactgacgctcatgcacaaaagcgtggggagcaaacagg

SEQ ID NO: 1113 - DNA, 253 bp, Unknown
  Description of Unknown: bacterium polynucleotide
  Betaproteobacteria
tacgtagggtgcgagcgttaatcggaattactgggcgtaaagcgtgcgcaggcggttcgttaagtcagatgtgaaagccccgagctcaacttgggaactgcatttgaaactggcgggctggagtgtggcagaggggggtggaattccacgtgtagcagtgaaatgcgtagagatgtggaggaacaccgatggcgaaggcagccccctgggccaacactgacgctcaggcacgaaagcgtggggagcaaacagg

SEQ ID NO: 1114 - DNA, 253 bp, Unknown
  Description of Unknown: bacterium polynucleotide
  Betaproteobacteria
tacgtagggtgcgagcgttaatcggaattactgggcgtaaagcgtgcgcaggcggttcgccaagtcaggtgtgaaatccccgggcttaacctgggaattgcgcttgaaactagcgggcttgagtgtggcagaggggggtggaattccacgtgtagcagtgaaatgcgtagagatgtggaggaacaccgatggcgaaggcagccccctgggtcaacactgacgctcatgcacgaaagcgtggggagcaaacagg

SEQ ID NO: 1115 - DNA, 253 bp, Unknown
  Description of Unknown: bacterium polynucleotide
  Betaproteobacteria
tacgtagggtgcgagcgttaatcggaattactgggcgtaaagtgtgcgcaggcggcttcgcaagtcgagtgtgaaatccccgagcttaacttgggaattgcgctcgaaactacggagctggagtgtggcagaggaaggtggaattccacgtgtagcggtgaaatgcgtagagatgtggaggaacaccagtggcgaaggcggctttctggcctgtaactgacgctgaggcgcgaaagcgtggggagcaaacagg

SEQ ID NO: 1116 - DNA, 253 bp, Unknown
  Description of Unknown: bacterium polynucleotide
  Betaproteobacteria
tacgtagggtgtaggcgttaatcggaattactgggcgtaaagcgtgcgcaggcggtctgctaagagagatgtgaaatccccgggcttaacctgggaactgcgtttctaactggcaggcttgagtgtggcagaggggggtggaattccacgtgtagcagtgaaatgcgtagagatgtggaggaacaccgatggcgaaggcagccccctgggctaacactgacgctcatgcacgaaagcgtggggagcaaacagg

SEQ ID NO: 1117 - DNA, 253 bp, Unknown
  Description of Unknown: bacterium polynucleotide
  Betaproteobacteria
tacgtagggtgcaggcgttaatcggaattactgggcgtaaagcgtgcgcaggcggtttgttaagacagatgtgaaatccccgggcttaacctgggaactgcgtttgtaactggcaagctagagtgtggcagaggggggtggaattccaagtgtagcagtgaaatgcgtagatatttggaggaacaccaatggcgaaggcagccccctgggttaacactgacgctcatgcacgaaagcgtggggagcaaacagg

SEQ ID NO: 1118 - DNA, 253 bp, Unknown
  Description of Unknown: bacterium polynucleotide
  Betaproteobacteria
tacgtaggtggcaagcgttgtccggatttattgggtttaaagggcgcgtaggcggctgcctaagtcgggtgtgaaagccccgggctcaacctgggaactgcgttggaaactgtcgggctagagtgtagaagaggggggtagaattccacgtgtagcagtgaaatgcgtagagatgtggaggaataccgatggcgagggcagccccctgggctaacactgacgctcatgcacgaaggcgtggggagcaaacagg

SEQ ID NO: 1119 - DNA, 253 bp, Unknown
  Description of Unknown: bacterium polynucleotide
  Betaproteobacteria
tacgtagggtgcaggcgttaatcggaattactgggcgtaaagcgtgcgcaggcggcctcttaagtcagatgtgaaatccccgggcttaacctgggaactgcgtttgaaactgggaggcttgagtgtggaagaggggggtggaattccaggtgtagcagtgaaatgcgtagagatctggaggaacaccgatggcgaaggcagccccctgggctaacactgacgctcatgcacgaaagcgtggggagcaaacagg

SEQ ID NO: 1120 - DNA, 253 bp, Unknown
  Description of Unknown: bacterium polynucleotide
  Betaproteobacteria
tacgtagggtgcgagcgttaatcggaattattgggcgtaaagggtgcgcaggcggttttttaagtcagatgtgaaatccccgagcttaacttgggaactgcatttgaaactgaaagactagagtgtgcgagaggggggtggaattccgcgtgtagcagtgaaatgcgtagatatgcggaggaacatcaatggcgaaggcagccccctggcgtaacactgacgctcatgcacgaaagcgtggggagcaaacagg

SEQ ID NO: 1121 - DNA, 253 bp, Unknown
  Description of Unknown: bacterium polynucleotide
  Betaproteobacteria
tacgtagggtgcgagcgttaatcggaattactgggcgtaaagcgtgcgcaggcggtgctgtaagacaggcgtgaaatccccgggcttaacctgggaatggcgcttgtgactgcagtgctggagtgtggcagagggggatggaattccgcgtgtagcagtgaaatgcgtagagatgtggaggaataccaatggcgaaggcagccccctgggataatattgacgctcatgcacgaaagcgtggggagcaaacagg

SEQ ID NO: 1122 - DNA, 253 bp, Unknown
  Description of Unknown: bacterium polynucleotide
  Betaproteobacteria
gacagaggcctcaagcgttaggcggaatcactgggcttaaagcgtgtgtaggcggacttttaagtgccttgtgaaatcccacggattaacctgggaactgcgtttgaaactggaaggctagagtgtggcagaggggggtggaattccacgtgtagcagtgaaatgcgtagatatgtggaggaacaccgatggcgaaggcagccccctgggctaacactgacgctcatgcacgaaagcgtggggagcaaacagg

SEQ ID NO: 1123 - DNA, 253 bp, Unknown
  Description of Unknown: bacterium polynucleotide
  Betaproteobacteria
tacgtagggtgcgagcgttaatcggaattactgggcgtaaagcgtgcgcaggcggttcgttgtgtcggcggtgaaagccccgggcttaacctgggaatggccgttgaaactggcgaactggagtgtggcagaggggggtggaattccgcgagtagcagtgaaatgcgtagagatgcggaggaacaccgatggcgaaggcagccccctgggctaacactgacgctcaggcacgaaagcgtggggagcaaacagg

SEQ ID NO: 1124 - DNA, 253 bp, Unknown
  Description of Unknown: bacterium polynucleotide
  Betaproteobacteria
tacggagggtgcaagcgttaatcggaattactgggcgtaaagcgtgcgcaggcggtttgctaagacaggtgtgaaatccccgggcttaacctaggaactgcgcttgtaactggcaagctagagtgtggcagaggggggtggaattccacgtgtagcagtgaaatgcgtagagatgtggaggaacaccgatggcgaaggcagccccctgggctaacactgacgctcatgcacgaaagcgtggggagcaaacagg

SEQ ID NO: 1125 - DNA, 253 bp, Unknown
  Description of Unknown: bacterium polynucleotide
  Betaproteobacteria
tacgtagggtgcgagcgttaatcggaattactgggcgtaaagcgtgcgcaggcggtttgttaagacaggtgtgaaatccccgggcttaacctgggaatggcgcttgtaactggcaaactcgagtacgtcagaggggggtggaattccacgtgtagcagtgaaatgcgtagagatgtggaggaacaccgatggcgaaggcagccccctgggatgatactgacgctcaggcacgaaggcgtggggagcaaacagg

SEQ ID NO: 1126 - DNA, 253 bp, Unknown
  Description of Unknown: bacterium polynucleotide
  Betaproteobacteria
tacgtagggtgcgagcgttaatcggaattactgggcgtaaagcgtgcgcaggtggttttgtaagccagatgtgaaatccccgggcccaacctgggaatggcatttgggactgcaaggctagagtgtggcagaggggggtggaattccgcgtgtagcagtgaaatgcgtagagatgcggaggaacaccgatggcgaaggcagccccctgggttgacactgacactcatgcacgaaagcgtggggagcagacagg

SEQ ID NO: 1127 - DNA, 253 bp, Unknown
  Description of Unknown: bacterium polynucleotide
  Betaproteobacteria
tacgtagggtgcgagcgttaatcggaattactgggcgtaaagcgtgcgcaggcggttatgcaagacagatgtgaaatccccgagcttaacttgggaattgcatttgtgactgcataactagagtgtgtcagagggaggtagaattccacgtgtagcagtgaaatgcgtagatatgtggaggaataccgatggcgaaggcagcctcctgggataacactgacgctcatgcacgaaagcgtggggagcaaacagg

SEQ ID NO: 1128 - DNA, 253 bp, Unknown
  Description of Unknown: bacterium polynucleotide
  Betaproteobacteria; Alcaligenaceae
tacgtagggtgcaagcgttaatcggaattactgggcgtaaagcgtgcgcaggcggtttggcaagaaggatgtgaaatcccagggcttaaccttggaactgcattcttaactgccaggctagagtatgtcagaggggggtagaattccgcgtgtagcagtgaaatgcgtagagatgcggaggaataccgatggcgaaggcagccccctgggataatactgacgctcatgcacgaaagcgtggggagcaaacagg

SEQ ID NO: 1129 - DNA, 253 bp, Unknown
  Description of Unknown: bacterium polynucleotide
  Betaproteobacteria; Alcaligenaceae
tacgtagggtgcaagcgttaatcggaattactgggcgtaaagcgtacgcaggcggctttgcaagacaggtgtgaaatccccgggcctaacctgggaactgcatttgtgactgcatggctagagtttgtcagaggggggtggaattccacgtgtagcagtgaaatgcgtagatatgtggaggaacaccgatggcgaaggcagccccctgggatgtgactgacgctcatgtacgaaagcgtggggagcaaacagg

SEQ ID NO: 1130 - DNA, 253 bp, Achromobacter sp.
  Betaproteobacteria; Alcaligenaceae; Achromobacter
tacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacagg

SEQ ID NO: 1131 - DNA, 253 bp, Pigmentiphaga sp.
  Betaproteobacteria; Alcaligenaceae; Pigmentiphaga
tacgtagggtgcaagcgttaatcggaattactgggcgtaaagcgtgcgcaggcggttcggaaagaaagatgtgaaatcccagggctcaaccttggaactgcatttttaactaccggactagagtatgtcagaggggggtggaattccacgtgtagcagtgaaatgcgtagatatgtggaggaacaccgatggcgaaggcagccccctgggataatactgacgctcatgcacgaaagcgtggggagcaaacagg

SEQ ID NO: 1132 - DNA, 253 bp, Burkholderia sp.
  Betaproteobacteria; Burkholderiaceae; Burkholderia
tacgtagggtgcaagcgttaatcggaattactgggcgtaaagcgtgcgcaggcggtccgttaagacagatgtgaaatccccgggcttaacctgggaactgcatttgtgactggcggactcgagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 1133 - DNA, 253 bp, Burkholderia sp.
  Betaproteobacteria; Burkholderiaceae; Burkholderia
tacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 1134 - DNA, 253 bp, Burkholderia sp.
  Betaproteobacteria; Burkholderiaceae; Burkholderia
tacgtaggaggcgagcgttgtccggagttactgggcgtaaagcgtgcacaggcggttcgctaagaccgatgtgaaatccccgggcttaacctgggaactgcattggtgactggcgagctagagtgtggcagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 1135 - DNA, 253 bp, Burkholderia sp.
  Betaproteobacteria; Burkholderiaceae; Burkholderia
tacgtagggtgcgagcgttaattggaattactgggcgtaaagcgtgcgcaggcggtctgttaagaccgatgtgaaatccccgggcttaacctgggaactgcattggtgactggcaggctagagtgtggcagagggaggtagaattccacgtgtagcagtgaaatgcgtagagatgtggaggaataccgatggcgaaggcagcctcctgggccaacactgacgctcatgcacgaaagcgtggggagcaaacagg

SEQ ID NO: 1136 - DNA, 254 bp, Burkholderia sp.
  Betaproteobacteria; Burkholderiaceae; Burkholderia
tacgtagggtgcgagcgttgatcggaattactgggcgtaaagcgtgcgcaggcggtctgttaagaccgatgtgaaatccccgggcttaacctgggaactgcattggtgactggcaggctttgagtatggcagaggggggtagaattccacgtgtagcagtgagatgcgtagagatgtggaggaataccgatggcgaaggcagccccctgggccaatactgacgctcacgcacgaaagcgtggggagcaaacagg

SEQ ID NO: 1137 - DNA, 252 bp, Lautropia sp.
  Betaproteobacteria; Burkholderiaceae; Lautropia
tacgtagggtgcaagcgttaatcggaattactgggcgtaaagagtgcgcaggcggttttgcaagaccgatgtgaaatccccgggcttaacctgggaactgcattggtgactgcaaggctagggtgtgtcagagggaggtggaattccgcatgtagcagtgaaatgcgtagatatgcggaggaacaccgatggcaaggcagcctcctgggataacactgacgctcatgcacgaaggcgtggggagcaaacagg

SEQ ID NO: 1138 - DNA, 253 bp, Unknown
  Description of Unknown: bacterium polynucleotide
  Betaproteobacteria; Comamonadaceae
tacgtagggtgcgagcgttaatcggaattactgggcgtaaagcgtgcgcaggcggctttgcaagacagaggtgaaatccccgggctcaacctgggaactgcctttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 1139 - DNA, 253 bp, Unknown
  Description of Unknown: bacterium polynucleotide
  Betaproteobacteria; Comamonadaceae
tacgtagggtgcgagcgttaatcggaattactgggcgtaaagcgtgcgcaggcggtaatgtaagacagatgtgaaatccccgggctcaacctgggacctgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1140 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggctatgcaagacaggtgtgaaatccccgggcttaacctgggaactgcacttgtgactgcatggctagagtgcgtcagagggaggtggaattccgcgtgtagcagtgaaatgcgtagagatgcggaggaacaccgatggcgaaggcaatcccctgggcctgcactgacgctcatgcacgaaagcgtggggagcaaacagg

SEQ ID NO: 1141 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggttctataagacagatgtgaaatccccgggctcaacctgggaactgcatttgtgactgtagagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1142 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaattttctgggcctgcactgacgctcatgcacgaaagcgtggggagcaaacagg

SEQ ID NO: 1143 - DNA, 253 bp, Unknown
  Description of Unknown: bacterium polynucleotide
  Betaproteobacteria; Comamonadaceae
gacagagggtgcgagcgttaatcggaattactgggcgtaaagcgtgcgtagatggttatgtaagtcggatgtgaaagccccgggctcaacctgggaattgcactcgagactgcatagctaggatgcggaagagggaagcggaatttccggtgtagcggtgaaatgcgtagatatgcggaggaacaccgatggcgaaggcaatcccctggacctgtactgacgctcatgcacgaaagcgtggggagcaaacagg

SEQ ID NO: 1144 - DNA, 253 bp, Unknown
  Description of Unknown: bacterium polynucleotide
  Betaproteobacteria; Comamonadaceae
tacgtagggtgcgagcgttaatcggaattactgggcgtaaagcgtgcgcaggtggttgtgcaagacagatgtgaaatccccgggcttaacctgggaattgcatttgtgactgcatagctagagtgcggcagagggggatggaattccgcgtgtagcagtgaaatgcgtagatatgcggaggaacaccgatggcgaaggcaatcccctgggcctgcactgacactcatgcacgaaagcgtggggagcaaacagg

SEQ ID NO: 1145 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggttatgcaagacagaggtgaaatccccggggtcaacctgggaactgcctttgtgactgcatagctagagtgcggcagagggggatggaattccgcgagtagcagtgaaatgcgtagatatgcggaggaacaccgatggcgaaggcaatcccctgggcctgcactgacgctcatgcacgaaagcgtggggagcaaacagg

SEQ ID NO: 1146 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggttatataagacagttgtgaaatccccgggctcaacctgggaactgcatctgtgactgtatagctagagtacggtagagggggatggaattccgcgtgtagcagtgaaacgcgtagatatgcggaggaacaccgatggcgaaggcaatcccctgggcctgcactgacgctcatgcacgaaagcgtggggagcaaacagg

SEQ ID NO: 1147 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggtcttgtaagacagaggtgaaatccccgggcttaacctgggaactgcctttgtgactgcaaggcttgagtgcggcagagggggatggaattccgcgtgtagcagtgaaatgcgtagatatgcggaggaacaccgatggcgaaggcaatcccctgggcctgcactgacgctcatgcacgaaggcgtggggagcaaacagg

SEQ ID NO: 1148 - DNA, 253 bp, Unknown
  Description of Unknown: bacterium polynucleotide
  Betaproteobacteria; Comamonadaceae
tacggagggggctagcgttattcggaattactgggcgtaaagcgtgcgcaggcggttatataagacagatgtgaaatccccgggctcaacctgggaactgcattcgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 1149 - DNA, 253 bp, Unknown
  Description of Unknown: bacterium polynucleotide
  Betaproteobacteria; Comamonadaceae
tacggaggatgcgagcgttaatcggaattactgggcgtaaagcgtgcgcaggcggctttgcaagacagatgtgaaatccccgggcttaacctgggaactgcatttgtgactgcaaggctagagtacggtagagggggatggaattccgcgtgtagcagtgaaatgcgtagatatgcggaggaacaccgatggcgaaggcaatcccctggacctgtactgacgctcacgcacgaaagcgtggggagcaaacagg

SEQ ID NO: 1150 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggttgtgcaagacagatgtgaaatccccgggctcaacttgggaactgcatttgtgactgcacggctagagtgcggcagagggagatggaattccgcgtgtagcagtgaaatgcgtagatatgcggaggaacaccgatggcgaaggcaatctcctgggcctgcactgacgctcatgcacgaaagcgtggggagcaaacagg

SEQ ID NO: 1151 - DNA, 253 bp, Unknown
  Description of Unknown: bacterium polynucleotide
  Betaproteobacteria; Comamonadaceae
tacggagggtgcaagcgttaatcggaattactgggcgtaaagcgtgcgcaggcggtcttgcaagacagatgtgaaatccccgggcttaacctgggaactgcatttgtgactgcaaggctggagtgcggcagagggggatggaattccacgtgtagcagtgagatgcgtagagatgtggaagaacaccgatggcgaaggcagccccctgggtcgacactgacgctcgtgcacgaaagcggggggagcaaacagg

SEQ ID NO: 1152 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcgggcggttatataagacagatgtgaaatccccgggctcaacctgggaactgcatttgtgactgtatagctagagtacggtagagggggatggaattccgcgtgtagcagtgaaatgcgtagatgtgcagaggagcaccgatggcgaaggcagtcccctgggcctgtactgacgctcatgcacgaaagcgtggggagcaaacagg

SEQ ID NO: 1153 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggccatgcaagacagatgtgaaatccccgggctcaacctgggaactgcatttgtgactgcatggctagagtacggcagagggggatggaattccgcgtgtagcagtgaaatgcgcagatatgcggaggaataccgatggcgaaggcaatcccctgggcctgtactgacgctcatgcacgaaagcgtggggagcaaacagg

SEQ ID NO: 1154 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggctttgtaagacagatgtgaaatccccgggctcaacctgggaactgcatttgtgactgcaaggctagagtacggtagaggggagtggaattccgcgtgtagcagtgaaatgcgtagatatgcggaggaacaccgatggcgaaggcagctccctggacctgtactgacgctcatgcacgaaagcgtggggagcaaacagg

SEQ ID NO: 1155 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggtcttttaagacagatgtgaaatccccgggcttaacctgggaactgcatttgtgactgaaaggctggagtacggcagagggggatggaattccgcgtgtagcagtgaaatgcgtagatatgcggaggaacaccgatggcgaaggcagtcccctgggcctgtactgacgctcatgcacgaaagcgtggggggcaaacagg

SEQ ID NO: 1156 - DNA, 253 bp, Unknown
  Description of Unknown: bacterium polynucleotide
  Betaproteobacteria; Comamonadaceae
tacgtagggtgcgagcgttaatcggaattactgggcctaaagcgtgcgcaggcggttttgcaagacaggtgtgaaatccccgggcttaacctgggaactgcgcttgtgactgcacagctggagtgcggcagagggggatggaattccgcgagtagcagtgaaatgcgtagatatgcggaggaacaccgatggcgaaggcaatcccctgggcctgcactgacgctcatgcacgaaagcgtggggagcaaacagg

SEQ ID NO: 1157 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggtgatgcaaggcagaggtgaaatccccgggctcaacctgggaactgcctttgtgactgcatgactagagtacggtagagggggatggaattccgcgtgtagcagtgaaatgcgtagatatgcggaggagcaccgatggcgaaggcaatcccctggacctgtactgacgctcatgcacgaaagcgtggggagcaaacagg

SEQ ID NO: 1158 - DNA, 253 bp, Unknown
  Description of Unknown: bacterium polynucleotide
  Betaproteobacteria; Comamonadaceae
tacgtagggtgcgagcgttaatcggaattactgggcgtaaagcgtgcgcaggtggtcatgtaagacagatgtgaaatccccgggcttaacctgggaattgcatttgtgactgcatggctagagtgtggcagagggggatggaattccgcgtgtagcagtgaaatgcgtagatatgcgggggaacaccgatggcgaaggcagtcccctgggcctgcactgacactcaagcacgaaagcgtggggagcaaacagg

SEQ ID NO: 1159 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggttatgcaagacaggtgtgaaatccccgagctcaacttgggaactgcatttgtgactgcatagctagagtacggtagaggggagtggaattccgcgtgtagcagtgaaatgcgtagatatgcggaggaacaccgatggcgaaggcagctccctggacctgtactgacgctcatgcacgaaagcgtggggagcaaacagg

SEQ ID NO: 1160 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggctatgcaagacagatgtgagatccccgggcttaacctgggaactgcatttgtgactgcatgtctagagtacggcagagggggatggaattccgcgtgtagcagtgaaatgcgtagatatgcggaggaacaccgatggcgaaggcaatcccctgggcctgtactgacgctcatgcgcgaaagcgtggggattaaacagg

SEQ ID NO: 1161 - DNA, 253 bp, Unknown
  Description of Unknown: bacterium polynucleotide
  Betaproteobacteria; Comamonadaceae
tacgtaaggtgcaagcgttaatcggaattactgggcgtaaagcgtgcgcaggcggttatgtaagacggttgtgaaatccccgggctcaacctgggaactgcatctgtgactgcatagctagagtacggtagagggggatggaattccgcgtgtagcagtgaaatgcgtagatatgcggaggaacaccgatggcgaaggcaatcccctggacctgtactgacgctgaggcacgaaagcgtggggagcaaacagg

SEQ ID NO: 1162 - DNA, 253 bp, Unknown
  Description of Unknown: bacterium polynucleotide
  Betaproteobacteria; Comamonadaceae
tacgtagggtgcaagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaagaacctgggccggaaaggacgctcatgcacgaaagcggggggagaaaaaagg

SEQ ID NO: 1163 - DNA, 253 bp, Comamonas sp.
  Betaproteobacteria; Comamonadaceae; Comamonas
tacggagggtgcaagcgttaatcggaattactgggcgtaaagcgtgcgcaggcggttttgtaagacagtggtgaaatccccgggctcaacctgggaactgccattgtgactgcaaagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1164 - DNA, 253 bp, Delftia sp.
  Betaproteobacteria; Comamonadaceae; Delftia
tacgtagggtgcgagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 1165 - DNA, 253 bp, Hydrogenophaga sp.
  Betaproteobacteria; Comamonadaceae; Hydrogenophaga
tacgtagggtgcaagcgttaatcggaattactgggcgtaaagcgtgcgcaggcggttttgtaagacaggcgtgaaatccccgggcttaacctgggaattgcgcttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1166 - DNA, 253 bp, Hylemonella sp.
  Betaproteobacteria; Comamonadaceae; Hylemonella
tacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 1167 - DNA, 253 bp, Lampropedia sp.
  Betaproteobacteria; Comamonadaceae; Lampropedia
tacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatgtcgaaggcaatcccctgggcctgcactgatgctcatgcacgaaagcgtggggagcaaacagg

SEQ ID NO: 1168 - DNA, 253 bp, Methylibium sp.
  Betaproteobacteria; Comamonadaceae; Methylibium
tacgtagggtgcaagcgttaatcggaattactgggcgtaaagcgtgcgcaggcggctttgcaagacagatgtgaaatccccgggcttaacctgggaactgcatttgtgactgcatggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1169 - DNA, 253 bp, Polaromonas sp.
  Betaproteobacteria; Comamonadaceae; Polaromonas
tacgtagggtgcgagcgttaatcggaattactgggcgtaaagcgtgcgcaggcggttatataagacagttgtgaaatccccggggtcaacctgggaattgcatctgtgactgtatagctagagtacggtagagggggatggaattccgcgagtagcagtgaaatgcgtagatatgcggaggaacaccgatggcgaaggcagtcccctggacctgtactgacgctcatgcacgaaagcgtggggagcaaacagg

SEQ ID NO: 1170 - DNA, 253 bp, Rubrivivax sp.
  Betaproteobacteria; Comamonadaceae; Rubrivivax
tacgtagggtgcaagcgttaatcggaattactgggcgtaaagcgtgcgcaggcggtcgtgcaagacaggtgtgaaatccccgggcttaacctgggaactgcacttgtgactgcacggctggagtacggcagagggggatggaattccgcgtgtagcagtgaaatgcgtagatatgcggaggaacaccgatggcgaaggcagtcccctgggcctgtactgacgctcatgcacgaaagcgtggggagcaaacagg

SEQ ID NO: 1171 - DNA, 253 bp, Tepidimonas sp.
  Betaproteobacteria; Comamonadaceae; Tepidimonas
tacgtagggtgcgagcgttaatcggaattactgggcgtaaagcgtgcgcaggcggtcttgtaagacagaggtgaaatccctgggctcaacctaggaatggcctttgtgactgcaaggctggagtgcggcagagggggatggaattccgcgtgtagcagtgaaatgcgtagatatgcggaggaacaccgatggcgaaggcagtcccctgggcctgcactgacgctcatgcacgaaagcgtggggagcaaacagg

SEQ ID NO: 1172 - DNA, 253 bp, Variovorax paradoxus
  Betaproteobacteria; Comamonadaceae; Variovorax paradoxus
tacgtagggcgcaagcgttaatcggaattactgggcgtaaagcgtgcgcaggcggttatgtaagacagttgtgaaatccccgggctcaacctgggaactgcatctgtgactgcatagctagagtacggtagagggggatggaattccgcgagtagtagtgaaatgcgtagatatgcggaggaacaccgatggcgaaggcaatcccctggacctgtactgatgctcatgcacgaaagcgtggggagcaaacagg

SEQ ID NO: 1173 - DNA, 253 bp, Variovorax sp.
  Betaproteobacteria; Comamonadaceae; Variovorax
tacggaggatccaagcgttaatcggaattactgggcgtaaagcgtgcgcaggcggtgatgtaagacagatgtgaaacccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1174 - DNA, 253 bp, Unknown
  Description of Unknown: bacterium polynucleotide
  Betaproteobacteria; EB1003
tacgtagggtgcaagcgttaatcggaattactgggcgtaaagagtgcgtaggcggttcttgaagcccgctgtgaaagccccgggcttaacctgggaatggcagtggaaactggaggacttgaattgagcagaggggggtggaatgccgcgtgtagcagtgaaatgcgtagagatgcggcggaacaccgatggcgaaggcagccccctgggcttaaattgacgctgaggcacgaaagcgtggggagcaaacagg

SEQ ID NO: 1175 - DNA, 253 bp, Unknown
  Description of Unknown: bacterium polynucleotide
  Betaproteobacteria; Methylophilaceae
tacgtagggtgcgagcgttaatcggaattactgggcgtaaagcgtgcgcaggcggttcgacaagtctgatgtgaaatccccgggctcaacctgggaactgcgttggaaactgtcgggctagagtgtagaagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 1176 - DNA, 253 bp, Unknown
  Description of Unknown: bacterium polynucleotide
  Betaproteobacteria; Methylophilaceae
tacgtagggtgcgagcgttaatcggaattactgggcgtaaagcgtgcgcaggcggttctgcaagtcagatgtgaaatccccgggctcaacctgggaactgcgtttgaaactacagagctagagtatgggagagggaggtagaattccacgtgtagcagtgtaatgcgtagagatgtggaggaataccaatggcgaaggcaggttactggaccatttctgacactgaggcacgaaagcgtggggagcgaaccgg

SEQ ID NO: 1177 - DNA, 253 bp, Unknown
  Description of Unknown: bacterium polynucleotide
  Betaproteobacteria; Methylophilaceae
tacgtagggtgcgagcgttaatcggaattactgggcgtaaagcgtgcgcaggcggttttgaaagtcagatgtgaaatccccgggctcaacctgggaactgcgtttgaaactccaaagctagagtatgggagaggggggtagaattccacgtgtagcagtgaaatgcgtagagatgtggaggaataccaatggcgaaggcagccccctggcctaatactgacgctcatgcacgaaagcgtggggagcaaacagg

SEQ ID NO: 1178 - DNA, 253 bp, Unknown
  Description of Unknown: bacterium polynucleotide
  Betaproteobacteria; Methylophilaceae
tacgtagggtgcgagcgttaatcggaattactaggcgcaaagcgtgcgcaggcggtcttgaaagtcagatgtgaaatccccgggctcaacctgggaactgcgtttgaaactccaagactagagtatggcagaggggggtagaattccacgtgtagcagtgtaatgcgtagagatgtggaggaataccaatggcgaaggcagccccctgggtcaatactgacgctcatgcacgaaagcgtggggagcaaacagg

SEQ ID NO: 1179 - DNA, 253 bp, Methylobacillus sp.
  Betaproteobacteria; Methylophilaceae; Methylobacillus
tacgtagggtgcgagcgttaatcggaattactgggcgtaaagcgagcgcaggcggttttgtaagtcagatgtgaaagccccgggctcaacctgggaactgcgtttgaaactacaaggctagagtataggagagggaggtagaattccacgtgtagcagtgaaatgcgtagagatgtggaggaataccaatggcgaaggcagcctcctggcctaatactgacgctcatgctcgaaagcgtggggagcaaacagg

SEQ ID NO: 1180 - DNA, 253 bp, Methylotenera mobilis
  Betaproteobacteria; Methylophilaceae; Methylotenera mobilis
tacgtagggtgcgagcgttaatcggaattactgggcgtaaagcgtgcgcaggctgttctgtaagtcagatgtgaaatccccgagctcaacttgggaactgcgtttgaaactacaggactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 1181 - DNA, 253 bp, Methylotenera mobilis
  Betaproteobacteria; Methylophilaceae; Methylotenera mobilis
tacgtagggtgcgagcgttaatcggaattactgggcgtaaagcgtgcgcaggcggcctgataagtcagatgtgaaatccccgagctcaacttgggaactgcgtttgaaactatcaagctagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 1182 - DNA, 253 bp, Methylotenera mobilis
  Betaproteobacteria; Methylophilaceae; Methylotenera mobilis
tacgtagggtgcgagcgttaatcggaattactgggcgtaaagcgtgcgcaggcggccttgaaagtcagatgtgaaatccccgagctcaacttgggaactgcgtttgaaactccaaggctagaatatgtcagaggggggtagaattccacgtgtagcagtgaaatgcgtagagatgtggaggaataccaatggcgaaggcagccccctgggataatatcgacgctcatgcacgaaagcgtggggagcaaacagg

SEQ ID NO: 1183 - DNA, 253 bp, Methylotenera mobilis
  Betaproteobacteria; Methylophilaceae; Methylotenera mobilis
tacgtagggtgcgagcgttaatcggaattactgggcgtaaagcgtgcgcaggcggtttggcaagtcagatgtgaaatccccgagctcaacttgggaactgcgtttgaaactgccagactagaatatgtcagaggggggtagaattccacgtgtagcagtgaaatgcgtagagatgtggaggaataccgatggcgaaggcagccccctgggccaacactgacgctcatgcacgaaagcgtggggagcaaacagg

SEQ ID NO: 1184 - DNA, 253 bp, Methylotenera mobilis
  Betaproteobacteria; Methylophilaceae; Methylotenera mobilis
tacgtagggtgcgagcgttaaccggaattactgggcgtaaagcgtgcgcaggcggctttgtaagtcagatgtgaaatccccgagctcaacttgggaactgcgtttgaaaccacaaggctagaatatgtcagaggggggtagaattccacgtgtagcagtgaaatgcgtagagatgtggaggaataccaatggcgaaggcagcccccaggggtaatattgacgctcatgcacgaaagcgtggggagcaaacagg

SEQ ID NO: 1185 - DNA, 253 bp, Unknown
  Description of Unknown: bacterium polynucleotide
  Betaproteobacteria; Neisseriaceae
tacgtagggtgcgagcgttaatcggaattattgggcgtaaagcgagtgtagacggttatttaagccagatgtgaaatacccgagcctaacttgggaggtgcatttggaactgggtagctagagtgtgtcagagggaggtagaactccacgtgtagcagtgaaatgcgtagagatgtggaagaataccgatggcgaaggcagcctcctgggataacactgacgttgaggctcgaaagcgtggggagcaaacagg

SEQ ID NO: 1186 - DNA, 253 bp, Unknown
  Description of Unknown: bacterium polynucleotide
  Betaproteobacteria; Neisseriaceae
tacgtagggtgcaagcgttaatcggaattactgggcgtaaagggtgtgtaggcggtttattaagtctgatgtgaaatccccgggctcaacctgggaactgcgttggatactggtaaactagagtatgtaagaggggggtggaattccacgtgtagcagtgaaatgcgtagagatgtggaggaacaccgatggcgaaggcaaccccctgggacaatactgacgctgaggcacgaaagcgtggggagcaaacagg

SEQ ID NO: 1187 - DNA, 253 bp, Neisseria subflava
  Betaproteobacteria; Neisseriaceae; Neisseria subflava
tacgtagggtgcgagcgttaatcggaattactgggcgtaaagcgagcgcagacggttacttaagcaggatgtgaaatccccgggctcaacctgggaactgcgttctgaactgggtgactagagtgtgtcagagggaggtagaattccacgtgtagcagtgaaatgcgtagaggtgtggaggaataccgatggcgaaggcagcctcctgggataacactgacgttcatgctcgaaagcgtgggtagcaaacagg

SEQ ID NO: 1188 - DNA, 253 bp, Neisseria oralis
  Betaproteobacteria; Neisseriaceae; Neisseria oralis
tacgtagggtgcgagcgttaaacggaattactgggcgtaaagcgggcgcagacggttacttaagcaggatgtgaaatccccgggttcaacctgggaattgcgttctgaactgggtggctagagtgtgtcagaggggggtagaattccacgtgtagcagtgaaatgcgtagagatgtggaggaataccgatggcgaaggcagccccctgggatagcactgacgttcatgcccgaaagcgtgggtagcaaacagg

SEQ ID NO: 1189 - DNA, 253 bp, Nitrosovibrio tenuis
  Betaproteobacteria; Nitrosomonadaceae; Nitrosovibrio tenuis
tacgtagggtgcaagcgttaatcggaattactgggcgtaaagcgtgcgcaggcggttttgtaagtcagatgtgaaatccccgggcttaacctgggaactgcgtttgaaactacaaggctagagtgtagcagaggggggtggtattccacgtgtagcagtgaaatgcgtagagatgtggaggaacaccgatggcgaaggcagccccctgggttaacactgacgctcaggcacgaaagtgtggggagcaaacagg

SEQ ID NO: 1190 - DNA, 253 bp, Unknown
  Description of Unknown: bacterium polynucleotide
  Betaproteobacteria; Oxalobacteraceae
tacgtagggcgcaagcgttaatcggaattactgggcgtaaagcgtgcgcaggcggttttgtaagtctgacgtgaaatccccgggcttaacctgggaatggcgttggagactgcaaggctggaatctggcagaggggggtagaattccacgtgtagcagtgaaatgcgtagagatgtggaggaccaccgatggcgaaggcagccccctgggctaagattgacgctcatgcacgaaagcgtggggagcaaacagg

SEQ ID NO: 1191 - DNA, 253 bp, Unknown
  Description of Unknown: bacterium polynucleotide
  Betaproteobacteria; Oxalobacteraceae
tacgtagggtgcaagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 1192 - DNA, 253 bp, Unknown
  Description of Unknown: bacterium polynucleotide
  Betaproteobacteria; Oxalobacteraceae
tacgtagggtgcaagcgttaatcggaattactgggcgtaaagcgtgcgcaggcggtttggtaagacagatgtgaaatccccgggcttaacctgggaattgcatttgtgactgcccggctagagtttggcagaggggggtagaattccacgtgtagcagtgaaatgcgtagatatgtggaggaataccgatggcgaaggcagccccctgggtcaagactgacgctcatgcacgaaagcgtggggagcaaacagg

SEQ ID NO: 1193 - DNA, 253 bp, Unknown
  Description of Unknown: bacterium polynucleotide
  Betaproteobacteria; Oxalobacteraceae
tacgtagggtgcaagcgttaatcggaattactgggcgtaaagcgtgcgcaggcggttatacaaggcagatgtgaaatccccgggctcaacctgggaattgcatttgtgactgtatggctagagtgtgtcagaggggggtagaattccacgtgtagcagtgaaatgcgtagatatgtggaggaattccgatggcgaaggcagccccctgggataacactgacgctcatgcacgaaagcgtggggagcaaacagg

SEQ ID NO: 1194 - DNA, 253 bp, Unknown
  Description of Unknown: bacterium polynucleotide
  Betaproteobacteria; Oxalobacteraceae
tacgaagggtgcaagcgttaatcggaattactgggcgtaaagcgtgcgcaggcggttgtgcaagacagatgtggaatccccgggctcaacctgggaattgcatttgtgactgcacggctagagtgtgtcagaggggggtagaattccacgagtagcagtgaaacgcgtagagatgtggaggaataccgatggcgaaggcagccccctgggataacactgacgctcatgcacgaaagcgtggggagcaaacagg

SEQ ID NO: 1195 - DNA, 253 bp, Unknown
  Description of Unknown: bacterium polynucleotide
  Betaproteobacteria; Oxalobacteraceae
tacgtagggtgcaagcgttaatcggaattactgggcgtaaagcgtgcgcaggcggttttgtaagtctgtcgtgaaatccccgggctcaacctgggaattgcgatggagactgcaaggctagaatatgtcagaggggggtagaattccacgtgtagcagtgaaatgcgtagagatgtggaggaataccaatggcgaaggcagccccctgggtcaagactgacgctcatgcacgaaagcgtggggagcaaacagg

SEQ ID NO: 1196 - DNA, 253 bp, Collimonas sp.
  Betaproteobacteria; Oxalobacteraceae; Collimonas
tacgtagggtgcaagcgttaatcggaattactgggcgtaaagcgtgcgcaggcggttgtgtaagacaggtgtgaaatccccgggcttaacctgggaatggcatttgtgactgcacggctagagtgtgtcagaggggggtagaattccacgtgtagcagtgaaaagcgtagagatgtggaggaataccgatggcgaaggcagccccctgggataacactgacgctcatgcacgtaagcgtggggagcaaacagg

SEQ ID NO: 1197 - DNA, 253 bp, Herbaspirillum sp.
  Betaproteobacteria; Oxalobacteraceae; Herbaspirillum
tacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 1198 - DNA, 253 bp, Herminiimonas sp.
  Betaproteobacteria; Oxalobacteraceae; Herminiimonas
tacagaggatgcaagcgttaatcggaattactgggcgtaaagcgtgcgcaggcggttatgtaagacagatgtgaaatgcccgggcttaacctgggaactgcatttgtgactgcatggctagagtgtgtcaggggggggtagaattccacgtgtagcagtgaaatgcgtagatatgtggaggaataccgatggcgaaggcagccccctgggataacactgacgctcatgcacgaaggcgtggggagcaaacagg

SEQ ID NO: 1199 - DNA, 253 bp, Janthinobacterium sp.
  Betaproteobacteria; Oxalobacteraceae; Janthinobacterium
tacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 1200 - DNA, 253 bp, Janthinobacterium lividum
  Betaproteobacteria; Oxalobacteraceae; Janthinobacterium lividum
tacgtagggtgcaagcgttaatcggaattactgggcgtaaagcgtgcgcaggcggttttgtaagtctgatgtgaactccccgggctcaacctgggaattgcactggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacagg

SEQ ID NO: 1201 - DNA, 253 bp, Janthinobacterium sp.
  Betaproteobacteria; Oxalobacteraceae; Janthinobacterium
tacggagggtgcaagcgttaatcggaattactgggcgtaaagcgtgcgcaggcggttttgtaagtctgttgtgaaatccccgggcttaacctgggaatggcaatggagactgcaaggctagagtttggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 1202 - DNA, 253 bp, Janthinobacterium sp.
  Betaproteobacteria; Oxalobacteraceae; Janthinobacterium
tacgtagggtgcaagcgttaatcggaattactgggcgtaaagcgtgcgcgggcggttttgtaggtctgtcgtgaaatccccgggctcaacctgggaattgcggtggggactgcaaggctagaatctggcagagggggggagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1203 - DNA, 253 bp, Janthinobacterium sp.
  Betaproteobacteria; Oxalobacteraceae; Janthinobacterium
tacgtagggtgcaagcgttaatcggaattactgggcgtaaagcgtgcgcaggcggttttgtaagtttgtcgtgaaatccccgggctcaacctgggaatggcgatgaagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1204 - DNA, 253 bp, Janthinobacterium sp.
  Betaproteobacteria; Oxalobacteraceae; Janthinobacterium
tacgaggggggcaagtgttgttcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1205 - DNA, 251 bp, Janthinobacterium sp.
  Betaproteobacteria; Oxalobacteraceae; Janthinobacterium
tacggagggggctagcgttgatcggaattactgggcgtaaagcgtgcgcaggcggttttgtagtctgttgtgaaattcccgggctcaacctgggaatggcaatggagactgcaaggctagagtttggcagaggggggtagaattccacgtgtagcagtgaaatgcgtagatatgtggaggaacaccgatggcgaaggcagccccctgggtcaaactgacgctcatgcacgaaagcgtggggagcaaacagg

SEQ ID NO: 1206 - DNA, 253 bp, Janthinobacterium sp.
  Betaproteobacteria; Oxalobacteraceae; Janthinobacterium
tacgtagggtgcaagcgttaatcggaattactgggcgtaaagcgtgcgcagccggttttgtaagtctattgtgaaatccccgggctcaacctgggaatggcgttggagactgcaaggctagagtttggcagaggggggtagaattccacgtgtagcaatgaaatgtgtagatatgtggaggaacaccgatggcgaaggcagccccctgggtcaagactgacgctcatgcacgaaagcgtggggagcaaacagg

SEQ ID NO: 1207 - DNA, 253 bp, Janthinobacterium sp.
  Betaproteobacteria; Oxalobacteraceae; Janthinobacterium
tacgcagggtgcaagcgttaatcggaattactgggcgtagagcgtgcgcaggcggttttgtaagtctgtcgtgaaatccccgggctcaacctgggaatggcgatggagactgcaaggctggaatctggcagaggggggtagaattccacgtgtagcagtgaaatgcgtagatatgtggaggaacaccgatggcgaaggcagccccctgggctaagattgacgctcatgcacgaaagcgtggggagcaaacagg

SEQ ID NO: 1208 - DNA, 253 bp, Massilia sp.
  Betaproteobacteria; Oxalobacteraceae; Massilia
tacgtagggtgcaagcgttaatcggaattactgggcgtaaagcgtgcgcaggcggttttgtaagtctgtcgtgaaagccccgggcttaacctgtgaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggggcaaacagg

SEQ ID NO: 1209 - DNA, 253 bp, Massilia haematophila
  Betaproteobacteria; Oxalobacteraceae; Massilia haematophila
gacggggggggcaagtgttaatcggaattactgggcgtaaagcgtgcgcaggcggttttgtaagtctgacgtgaaagccccgggctcaacctgggaattgcgttggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1210 - DNA, 253 bp, Massilia alkalitolerans
  Betaproteobacteria; Oxalobacteraceae; Massilia alkalitolerans
tacgtaggatgcaagcgttaatcggaattactgggcgtaaagcgtgcgcaggcggttttgtaagtctgtcgtgaaagccccgggctcaacctgggaattgcgatggagactgcaaggctagaatctggcagaggggggtagaattccacgtgtagcagtgaaatgcgtagatatcgtaaggaagaccagtggcgaaggcgagttcctggacagttactgacactgaggcacgaaggccaggggagcaaacagg

SEQ ID NO: 1211 - DNA, 253 bp, Massilia alkalitolerans
  Betaproteobacteria; Oxalobacteraceae; Massilia alkalitolerans
tacgtagggtgcaagcgttaaccggaattactgggcgtaaagcgcgcgcaggcggttttgtgagtttgtcgtgaaagccccgggctcaacctgggaattgcgatgaagactgcaaggcttaaatctggcagaggggggtagaattccacgtgtagcagtgtaatgcgtagagatgtggaggaacaccgatggcgaaggcagccccctgggtcaagattgacgctcatgcacgaaagcgtggggagcaaacagg

SEQ ID NO: 1212 - DNA, 253 bp, Massilia alkalitolerans
  Betaproteobacteria; Oxalobacteraceae; Massilia alkalitolerans
tacgtagggtgcaggcgttgtccggatttactgggcgtaaagcgtgtgtaggcggacctttaagtagaaagtgaaaggttggtgctcaacaccaacattgctctctatactggaggtcttgagtgtcggagaggaagatggaactccacgtgtagcagtgaaatgcgtagagatgtggaggaacaccgatggcgaaggcagccccctgggtcaagattgacgctcatgcacgaaagcgtggggagcaaacagg

SEQ ID NO: 1213 - DNA, 253 bp, Massilia haematophila
  Betaproteobacteria; Oxalobacteraceae; Massilia haematophila
tacgtagggtgcaagcgttaatcggaattactgggcgtaaagcgtgcgcaggcggttttgtaagtctgacgtgaaatccccgggctcaacctgggaattgcgttggagactgcatggctagaatctggcagaggggggtagaattccacgtgtagcagtgaaatgcgtagatataggaaggaacatcagtggcgaaggcagctgactacgctacatctgacactgaggcacgaaagcgtggggagcgaacagg

SEQ ID NO: 1214 - DNA, 253 bp, Unknown
  Description of Unknown: bacterium polynucleotide
  Betaproteobacteria; Procabacteriaceae
tacgtagggtgcgagcgttaatcggaattactgggcgcaaagcgtgcgcaggcggatgtttaagttaggagtgaaatccccgggctcaacctgggaatagcttttaagactgggcatctagagtttgtcagaggggggtggaattccaagtgtagcagtgaaatgcgtagagatttggaggaacaccgatggcgaaggcagccccctgggataaaactgacgctcatgcacgaaggcgtgggtagcaaacagg

SEQ ID NO: 1215 - DNA, 254 bp, Unknown
  Description of Unknown: bacterium polynucleotide
  Betaproteobacteria; Rhodocyclaceae
tacgtagggtgcgagcgttaatcggaattactgggcgtaaagcgtgcgcaggcggttgtgtaagacaggtgtgaaatcccccgggcttaacctgggaactgcgcttgtgactgcaaggctcgagtgtggcagaggggggtggaattccacgtgtagcagtgaaatgcgtagagatgtggaggaacaccgatggcgaaggcagccccctgggtcaacactgacgctcatgcacgaaagcgtgggtagcaagcagg

SEQ ID NO: 1216 - DNA, 253 bp, Hydrogenophilus sp.
  Betaproteobacteria; Rhodocyclaceae; Hydrogenophilus
tacgtagggtgcgagcgttaatcggatttactgggcgtaaagcgtgcgcaggcggcccgttaagacaggtgtgaaatccctgggctcaacctaggaattgcgcttgtgactggcgggctggagtacggtagaggggggtggaattcctggtgtagcagtgaaatgcgtagagatcaggaggaacaccgatggcgaaggcagccccctgggcctgtactgacgctcatgcacgaaagcgtggggagcaaacagg

SEQ ID NO: 1217 - DNA, 253 bp, Petrobacter succinatimandens
  Betaproteobacteria; Rhodocyclaceae; Petrobacter succinatimandens
tacgtagggtgcgagcgttaatcggaattactgggcgtaaagggtgcgcaggcggccctgtaagaccggtgtgaaatccccgggctcaacctgggaattgcgctggtgactgcagggctagagtacggtagaggggggtggaattcctggtgtagcagtgaaatgcgtagagatcaggaggaacaccgatggcgaaggcagccccctgggcctgtactgacgctcatgcacgaaagcgtggggagcaaacagg

SEQ ID NO: 1218 - DNA, 253 bp, Unknown
  Description of Unknown: bacterium polynucleotide
  BME43
tacggagggtgcaagcgttgtccggattcattgggtttaaagggtgcgtaggcggcctggtaagtcagcggcgaaatacccacgctcaacgtgggaactgccgttgatactgccgggcttgagttcgtgcgaggtcgctggaatgcgtggtgtagcggtgaaatgcgtagatatcacgcagaacaccgattgcgaaggcaggtgactggcacgcgactgacgctgaggcacgaaagtgtggggagcaaacagg

SEQ ID NO: 1219 - DNA, 253 bp, Unknown
  Description of Unknown: bacterium polynucleotide
  C0119
tacgtaggatgcaagcgttgtccggatttactgggcgtaaagcgcgcgcaggcggcacctcaagtattcagtgaaatctccctgctcaacggggagggtgctgagtagactgaggagctagaggacggtagaggggggtagaattgctggtgtagcggtgaaatgcgtagagatcagcaggaatacccgtggcgaaggcggccccctgggccgtttctgacgctgaggtgcgaaggctaggggagcgaacggg

SEQ ID NO: 1220 - DNA, 253 bp, Unknown
  Description of Unknown: bacterium polynucleotide
  C0119
tacgtaggaggcaagcgttgtccggaatcactgggcgtaaagcgcgtgtaggtggtgcgacaagtctgctgtgaaagcgcctggcttaaccgggcgaggtcggcggaaactggcgtgctggaggccggtagaggggggtggaattcccggtgtagtggtgaaatgcgtagagatcgggaggaacaccagtggcgaaggcggccccctgggccgggcctgacactgagacgcgaaggcgtggggagcgaacggg

SEQ ID NO: 1221 - DNA, 253 bp, Unknown
  Description of Unknown: bacterium polynucleotide
  C0119
tacgtaggaggcgagcgttgtccggatttactgggcgtaaagcgcgcgcaggcggcacttcaagtaaggtgtgaaatctccctgctcaacggggagggtgcactttagactgaggagctcgaggacggtagaggggggtggaattgctggtgtagcggtgaaatgcgtagagatcagcaggaacacccgtggcgaaggcggccccctgggccgtacctgacgctgaggcgcgaaggctaggggagcgaacggg

SEQ ID NO: 1222 - DNA, 253 bp, Unknown
  Description of Unknown: bacterium polynucleotide
  C0119
tacgtaggatgcaagcgttgtccggatttactgggcgtaaagcgcgcgcaggcggcatggtaagtaaggtgtgaaatccatctgctcaacgggtggggtgcactttagactgccaagcttgaggtcggtagaggggggtagaattgctggtgtagcggtgaaatgcgtagagatcagcaggaatacccgtggcgaaggcggccccctgggccgtacctgacgctgaggcgcgaaggctaggggagcgaacggg

SEQ ID NO: 1223 - DNA, 253 bp, Unknown
  Description of Unknown: bacterium polynucleotide
  Chlamydiia
tacggagggtgcaagcattgatcggaattactgggcgtaaagggcgcgtaggcggtttgataagtcagatgtgaaattccggggctcaaccccggagctgcatttgaaactatcaagctagaggacagttagggaaaacggaattccacatgtagcggtgaaatgcgtagatatgtggaagaacaccggtggtgaagacggttttctgggctgtaactgacgctgaggcgcgaaagctaggggagcaaacagg

SEQ ID NO: 1224 - DNA, 254 bp, Unknown
  Description of Unknown: bacterium polynucleotide
  Chlamydiia
tacggagggtgcaagcattaatcggatttattgggcgtaaagggcgcgtaggcggccttgcaagtcagatgtgaaagcccggggctcaaccccggaactgcatttgaaactgcttggctttgggggtggtcggagaaaatggaattccacaagtagcggtgaaatgcgtagatatgtggaagaacaccggtggcgaaagcggttttctagattactcctgacgctgaggcgcgaaagctaggggagcaaacagg

SEQ ID NO: 1225 - DNA, 253 bp, Unknown
  Description of Unknown: bacterium polynucleotide
  Chlamydiia
tacggagggtgcaagcattgatcggaattactgggcgtaaagggcgcgtaggcggcctgaaaagtcagatgtgaaattccggggctcaaccccggagctgcatttgaaactttcaggcttgaggttagtaagggaaaacggaattccacgtgtagcggtgaaatgcgtagatatgtggaagaacaccggtggtgaagacggttttctgtgctaaacctgacgctgaggcgcgaaagctaggggagcaaacagg

SEQ ID NO: 1226 - DNA, 253 bp, Unknown
  Description of Unknown: bacterium polynucleotide
  Chlamydiia
tacagagggtgcaagcgttaatcggaattactgggcgtaaagggcgcgtaggcgggaaagaaagtcagatgtgaaataccggggctcaacttcggtgctgcatctgaaacttcttttctggagggtcagcggagaaaatggaattccacgtgtagcggtgaaatgcgtagatatgtggaggaacacctgtggcgaaagcggttttctagctgatttctgacgctgaggcgcgaaagcaaggggagcaaacagg

SEQ ID NO: 1227 - DNA, 253 bp, Unknown
  Description of Unknown: bacterium polynucleotide
  Chlamydiia
tacggagggtgcaagcattgatcggaattactgggcgtaaagggcgcgtaggcggcagtgtaagttggatgtgaaattccgtggctcaactgcggagctgcattcaagactgcacagctagaggatagttagggaaaacggaattccacgtgtagcggtgaaatgcgtagatatgtggaagaacaccggtggtgaagacggttttctgggctataactgacgctgaggcgcgaaagctaggggagcaaacagg

SEQ ID NO: 1228 - DNA, 253 bp, Unknown
  Description of Unknown: bacterium polynucleotide
  Chlamydiia
tacggagggtgcaagcattgatcggaattactgggcgtaaagggcgcgtaggcggttcaataagtcagatgtgaaattccggggctcaaccccggagctgcatttgaaactatggaactagagttcagttagggtaaacggaattccacgtgtagcggtgaaatgcgtagatatgtggaagaacaccggcggtgaagacggtttactgggctgagactgacgctgaggcgcgaaagcatggggagcaaacagg

SEQ ID NO: 1229 - DNA, 253 bp, Unknown
  Description of Unknown: bacterium polynucleotide
  Chlamydiia
tacggagggtgcaagcattgatcggaattactgggcgtaaagggcgcgcaggcggtcaggaaagtcagatgtgaaattccggggctcaaccccggagctgcatttgaaacttcctatctagagttcagttagggaaaacggaattccacgtgtagcggtgaaatgcgtagatatgtggaagaacaccagtggtgaagacggttttctgggctgatactgacgctgaggcgcgaaagcaaggggagcaaacagg

SEQ ID NO: 1230 - DNA, 253 bp, Unknown
  Description of Unknown: bacterium polynucleotide
  Chlamydiia
tacggagggtgcaagcgttagtcggaattactgggcgtaaagggtgcgtaggcggatatgtaagtcagacgtgaaattccgaggctcaacctcggagctgcatctgaaactgcgtatctagcggaatggcggagaaaacggaattccacgtgtagcggtgaaatgcgtagatatgtggaagaacacctgtggcgaaagcggttttctagcctactccggacgctgaggcacgaaagcaaggggatcaaacagg

SEQ ID NO: 1231 - DNA, 253 bp, Unknown
  Description of Unknown: bacterium polynucleotide
  Chlamydiia
tacggagggtgcaagcattgatcggaattactgggcgtaaagggcgcgtaggcggcaggtaaagtcggatgtgaaattccggggctcaaccccggagctgcatttgaaacttacccgctagagtacagttagggaaatcggaattccacgtgtagcggtgaaatgcgtagatatgtggaagaacaccggtggtgaagacggatttctgggctgtaactgacgctgaggcgcgaaagctaggggagcaaacagg

SEQ ID NO: 1232 - DNA, 253 bp, Unknown
  Description of Unknown: bacterium polynucleotide
  Chlamydiia
tacggagggtgcaagcattgatcggaattactgggcgtaaagggcgcgtaggcggtactgtaagtcggacgtgaaattccgtggctcaaccacggagctgcgtttgaaactacagaactagagtacagttagggtaaacggaattccacgtgtagcggtgaaatgcgtagatatgtggaagaacaccggtggtgaagacggtttactgggctgaaactgacgctgaggcgcgaaagcatggggagcaaacagg

SEQ ID NO: 1233 - DNA, 253 bp, Unknown
  Description of Unknown: bacterium polynucleotide
  Chlamydiia
tacggaaggtgcaagcattaatcggatttattgggcgtaaagggcgcgtaggcgggtcagcaagttagatgtgaaatttcggggcttaaccccgaagctgcatttaaaactactgatcttgagggtaggcggagaaaatggaattccacgtgtagcggtgaaatgcgtagatacgtggaggaacaccggtggcgaaagcggttttctagcttatacctgacgctgaggcgcgagagcaaggggagcaaacagg

SEQ ID NO: 1234 - DNA, 253 bp, Unknown
  Description of Unknown: bacterium polynucleotide
  Chlamydiia
tacggagggtgcaagcattgatcggaattactgggcgtaaagggcgcgtaggcggcttagaaagtcagatgtgaaattccggggctcaaccccggagctgcatttgaaactcctaagctagagtacaattagggaaaacggaattccacgtgtagcggtgaaatgcgtagatatgtggaagaacacctgtggcgaaagcggttttctagcttactcctgacgctgaggcgtgaaagcaaggggagcaaacagg

SEQ ID NO: 1235 - DNA, 253 bp, Unknown
  Description of Unknown: bacterium polynucleotide
  Chlamydiia
tacggagggtgcaagcattaatcggatttattgggcgtaaagggcgcgtagacggtttaggaagtcagaagtgaaattccggggctcaacctcggagcggcatctgaaactcctaaactcgaggataggtggggaaaacggaattccacatgtagcggtgaaatgcgtagatatgtggaagaacaccggtggcgaaggcggttttctaacctacacctgacgttgaggcgcgaaagcgtggggagcaaacagg

SEQ ID NO: 1236 - DNA, 253 bp, Unknown
  Description of Unknown: bacterium polynucleotide
  Chlamydiia
tacggagggtgcaagcattaatcggatttattgggcgtgaagagcgcgtaggcgggaaagaaagttggatgtgaaagctcgaggctcaacctcgaaaccgcatccaaaactccttttctagaggatggacggagaaaatggaattccacgtgtagcggtgaaatgcgtagatatgtggaagaacaccagtggcgaaggcgattttctagtttattcctgacgctaatacgcgaaagcaaggggagcaaacagg

SEQ ID NO: 1237 - DNA, 253 bp, Unknown
  Description of Unknown: bacterium polynucleotide
  Chlamydiia
tacagtgggtgcaagcgttaatcggagttactgggcgtaaagggcgcgtaggcggataaggaagtcagatgtgaaattccggggctcacccccggagctgcatttgaaactcttcatctagaggataggcggagaaaacggaattccacgtgtagcggtgaaatgcgtagatatgtggaagagcaccggtggcgaaggcggttttctagcttattcctgacgctgaggcgcgaaagcaaggggagcaaacagg

SEQ ID NO: 1238 - DNA, 253 bp, Unknown
  Description of Unknown: bacterium polynucleotide
  Chlamydiia
tacggagggtgcaagcattgatcggaattactgggcgtaaagggcgcgtaggcggcacgaaaagtcagatgtgaaattccggggctcaaccccggagctgcatttgaaactttcgagctagagggaacttagggaaaacggaattccacgtgtagcggtgaaatgcgtagatatgtggaagaacaccagtggtgaagacggttttctagggttttcctgacgctgaggcgcgaaagctaggggagcaaacagg

SEQ ID NO: 1239 - DNA, 253 bp, Unknown
  Description of Unknown: bacterium polynucleotide
  Chlamydiia
tacggagggtgcaagcgttagtcggaattactgggcgtaaagggtgcgtaggcggacaagtaagtcaattgtgaaattccggggctcaaccccggagctgcaactgaaactgcttgtctagagggatggcggagaaaacggaattccacgtgtagcggtgaaatgcgtagatatgtggaagaacacctgtggcgaaggcggttttctagcctccccctgacgctgaggcacgaaagcaaggggagcaaacagg

SEQ ID NO: 1240 - DNA, 253 bp, Unknown
  Description of Unknown: bacterium polynucleotide
  Chlamydiia
tacggagggtgcaagcattgatcggaattactgggcgtaaagggcgcgtaggcggttatgaaagtcagatgtgaaattccgaggctcaacctcggagctgcatttgaaactccacaactagagttcagttagggtaaacggaattccacgtgtagcggtgaaatgcgtagatatgtggaagaacaccagtggtgaagacggtttactgggctgagactgacgctgaggcgcgaaagcatggggagcaaacagg

SEQ ID NO: 1241 - DNA, 253 bp, Unknown
  Description of Unknown: bacterium polynucleotide
  Chlamydiia
tacggagggtgcaagcattaatcggatttattgggcgtaaagggcgcgtaggcggtttaataagtcggatgtgaaattccggggctcaaccccggagcggcatttgaaactgttaaactagagtacagttagggtaaacggaattcctcgtgtagcggtgaaatgcgtagatatgtggaagaacaccagtggcgaaagcggttttctagtttatacctgacgctgaggcgcgagagcaaggggagcaaacagg

SEQ ID NO: 1242 - DNA, 253 bp, Unknown
  Description of Unknown: bacterium polynucleotide
  Chlamydiia
tacggagggtgcaagcattgatcggaattactgggcgtaaagggcgcgtaggcggtttaataagtcggatgtgaaattccggggctcagccccggagctgcatttgaaactgttgaactagagtacagttagggtaaacggaattccacgtgtagcggtgaaatgcgtagatatgtggaagaacaccggtggtgaagacggtttactgggctgtaactgacgctgaggcgcgaaagcatggggagcaaacagg

SEQ ID NO: 1243 - DNA, 253 bp, Unknown
  Description of Unknown: bacterium polynucleotide
  Chlamydiia
tacggagggtgcaagcattgatcggaattactgggcgtaaagggcgcgtaggcggttgtataagtcagatgtgaaattccggggctcaaccccggagctgcatttgaaactgcatgactagagtacagttagggtaaacggaattccacgtgtagcggtgaaatgcgtagatatgtggaagaacaccggtggtgaagacggtttactgggctgtaactgacgctgaggcgcgaaagcatggggagcaaacagg

SEQ ID NO: 1244 - DNA, 253 bp, Unknown
  Description of Unknown: bacterium polynucleotide
  Chlamydiia
tacgaagggtgcaagcgttaatcggaattactgggcgtaaagggcgcgtaggcggtaagataagtcagatgtgaaattccggggctcaaccccggagctgcatttgaaactgtctaactagagtgcagttagggtaaacggagttccacgtgtagcggtgaaatgcgtagatatgtggaagaacaccggtggtgaagacggtttactgggctgaaactgacgctgaggcgcgaaagcatggggagcaaacagg

SEQ ID NO: 1245 - DNA, 253 bp, Unknown
  Description of Unknown: bacterium polynucleotide
  Chlamydiia
tacggagggtgcaagcattgatcggaattactgggcgtaaagggcgcgtaggcggtctagaaagtcagatgtgaaattccggggctcaaccccggagcgtcatttgaaactcctagactagaggatggttagggaaaacggaattccacgtgtagcggtgaaatgcgtagatatgtggaagaacaccggtggtgaagacggttttctgggccaatcctgacgctgaggcgcgaaagctaggggagcaaacagg

SEQ ID NO: 1246 - DNA, 253 bp, Unknown
  Description of Unknown: bacterium polynucleotide
  Chlamydiia
tacgtagggcgcaagcattaatcggatttactgggcgtaaagggtgcgtaggcggggaagaaagttagatgtgaaatttcagggctcaactctgaaacggcatctaatactacttttcttgaggataggaggggaaaggggaattccacatgtagcggtgaaatgcgtagatatgtggaggaacaccggtggcgaaggcgcctttctggcctattcctgacgctgatgcacgaaagcaaggggagcaaacagg

SEQ ID NO: 1247 - DNA, 253 bp, Unknown
  Description of Unknown: bacterium polynucleotide
  Chlamydiia
tacggagggtgcaagcattgatcggaattactgggcgtaaagggcgcgtaggcggttttataagtcggatgtgaaattccagggctcaaccctggagctgcatttgaaactgtaagactagagttcagttagggtaaacggaattccacgtgtagcggtgaaatgcgtagatatgtggaagaacaccggtggtgaaaacggtttactgggctgaaactgacgctgaggcgcgaaagcatggggatcaaacagg

SEQ ID NO: 1248 - DNA, 253 bp, Unknown
  Description of Unknown: bacterium polynucleotide
  Chlamydiia
tacggagggtgcaagcattgatcggaattactgggcgtaaagggcgcgtaggcggtcaggaaagtcagatgtgaaattccgaggctcaacctcggagctgcatttgaaactttctgactagagagcagttggggaaaacggaattccacgtgtagcggtgaaatgcgtagatatgtggaagaacaccggtggtgaagacggttttctgagctgcaactgacgctgaggcgcgaaagcaaggggagcaaacagg

SEQ ID NO: 1249 - DNA, 253 bp, Unknown
  Description of Unknown: bacterium polynucleotide
  Chlamydiia; Chlamydiaceae
tacggagggtgcaagcgttaatcggatttattgggcgtaaagggcgcgtaggcggggaagtaagttagatgtgaaattctggggctcaactccaggcccgcatctaatactatttttctagaggataggtggagaaaagggaattccacgtgtagcggtgaaatgcgtagatatgtggaagaacaccggtggcgaaggcgcttttctaacttaagcctgacgctgaggcgcgaaagcgaggggagcaaacagg

SEQ ID NO: 1250 - DNA, 253 bp, Unknown
  Description of Unknown: bacterium polynucleotide
  Chlamydiia; Chlamydiaceae
tacggagggtgcaagcgttaatcggatttattgggcgtaaagagcacgtaggccgaatggaaagttagatgtgaaagcccggggctcaactccggacccgcatctaaaactcccattctagaggatggacggagaaaagggaattccacgcgtagcggtgaaatgcgtagatatgtggaggaacaccggtggcgaaggcgcttttctagtttattcctgacgctgaggcgcgaaagcatggggagcaaacagg

SEQ ID NO: 1251 - DNA, 253 bp, Unknown
  Description of Unknown: bacterium polynucleotide
  Chlamydiia; Chlamydiaceae
tacggagggtgcaagcgttaatcggatttactgggcgtaaagagcacgtaggctgagtggaaagttagatgtgagatcccggggctcaactccggacccgcatctaaaactaccactctcgaggatagacggagaaaagggaattccacgtgtagcggtgaaatgcgtagatatgtggaagaacaccggtggcgaaggcgcttttctagtttattcctgacgctgaggtgcgaaagcaaggggagcaaacagg

SEQ ID NO: 1252 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcgggaatataagtcagacgtgaaatcccgaggctcaacctcggaactgcatttgaaactatatttcttgagggtaggaggagaaaacggaattccacaagtagcggtgaaatgcgtagatatgtggaagaacaccggtggcgaaggcggttttctatcttactcctgacgctgatgcgcgaaagctaggggagcaaacagg

SEQ ID NO: 1253 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggtaaggaaagtcagatgtgaaattccggggctcaacctcggagcagcatctgaaacttccatacttgaggaaaagcggggaaaacggaattccacatgtagcggtgaaatgcgtagatatgtggaagaacaccggtggcgaaggcggttttctagctttttcctgacgctgaggcgcgaaagcgtggggagcaaacagg

SEQ ID NO: 1254 - DNA, 253 bp, Unknown
  Description of Unknown: bacterium polynucleotide
  Chlamydiia; Parachlamydiaceae
tacgtagggtgcaagcattaatcggatttattgggcgtaaagggcgcgtaggcggaaatgccagtcagatgtgaaagcccggggctcaaccccggaacagcatttgaaactacatttctagagggtaggcggagaaaacggaattccacaagtagcggtgaaatgcgtagatatgtggaagaacaccagtggcgaaggcggttttctagcttatacctgacgctgaggcgcgaaagcaaggggagcaaacagg

SEQ ID NO: 1255 - DNA, 253 bp, Unknown
  Description of Unknown: bacterium polynucleotide
  Chlamydiia; Parachlamydiaceae
tacggagggtgcgagcattaatcggaattattgggcgtatagggcgcgtaggcggaccttttagtcggatgtgaaatcctagggctcaaccttagaactgcatccgaaactggaggtctagagggtaggaggagaaaacggaattccacaagtagcggtgaaatgcgtagatatgtggaagaacacctgtggcgaaagcggttttctatcttattcctgacgctgaggcgcgaaagcaaggggatcaaacagg

SEQ ID NO: 1256 - DNA, 253 bp, Unknown
  Description of Unknown: bacterium polynucleotide
  Chlamydiia; Parachlamydiaceae
tacgtagggtgcaagcattaatcggatttattgggcgtaaagggcgcgtaggcgggggtgcaagtcaattgtgaaatcccggggctcaacctcggaactgcatttgaaactacatccctagagggtaggcggagaaaacggaattccacaagtagcggtgaaatgcgtagatatgtggaagaacaccagtggcgaaggcggttttctagcttatacctgacgctgaggcgcgaaagcatggggagcaaacagg

SEQ ID NO: 1257 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggctggacgataagtcagatgtgaaatcccggggctcaaccccggaacagcatttgaaactatcattcttgaggatagagggagaaaacggaattccacaagtagcggtgaaatgcgtagatatgtggaagaacaccggtggcgaaggcggttttctactttagacctgacgctgaggcgcgaaagcaaggggatcaaacagg

SEQ ID NO: 1258 - DNA, 253 bp, Unknown
  Description of Unknown: bacterium polynucleotide
  Chlamydiia; Parachlamydiaceae
tacgtagggtgcgagcattaatcggatttattgggcgtaaaggacgcgtaggcgggatgttaagtcagatgtgaaagcccggagctcaactccggaacagcatttgaaactagcattcttgagggtagacggagaaaacggaattccacatgtagcggtgaaatgcgtagatatgtggaagaacaccagtggcgaaggcggttttctagtttatacctgacgctgatgcgtgaaagcaaggggatcaaacagg

SEQ ID NO: 1259 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggataaggaagtcagatgtgaaatcccggggctcaaccccggaacagcatttgaaactaagtatctagagggtaggcggagaaaacggaattccacaagtagcggtgaaatgcgtagatatgtggaagaacaccggtggcgaaggcggttttctagcttaaacctgacgctgaggcgcgaaagcaaggggatcaaacagg

SEQ ID NO: 1260 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggggaatcaagtcagatgtgaaatcccggggctcaacctcggaactgcatttgaaactggttctcttgagggtaggcggagaaaacggaattccacaagtagcggtgaaatgcgtagatatgtggaagaacaccggtggcgaaggcggttttctagcttatacctgacgctgaggcgcgaatgcaaggggatcaaacagg

SEQ ID NO: 1261 - DNA, 253 bp, Unknown
  Description of Unknown: bacterium polynucleotide
  Chlamydiia; Parachlamydiaceae
tacagagggtgcaagcattaatcggatttattgggcgtaaagggcgcgtaggcggaacgataagtcagatgtgaaatcccggggctcaaccccggaacagcatttgaaactatcgatctagagggtaggaggagaaaatggaattccacgtgtagcggtgaaatgcgtagatatgtggaagaacaccggtggcgaaggcgattttctatcttatacctgacgctgaggcgcgaaagcaagaggatcaaacagg

SEQ ID NO: 1262 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcgggtttgtaagtcagatgtgaaatcccggggctcaacctcggaacagcatttgaaactgcatacctagagggtaggcggagaaaacggaattccacaagtagcggtgaaatgcgtagatatgtggaagaacaccggtggcgaaggcggttttctagcttactcctgacgctgaggcgcgaaagcaaggggatcaaacagg

SEQ ID NO: 1263 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggataagaaagtcagatgtgaaataccggggctcacccccggaacggcatttgaaacttcttatcttgagggtaggcggagaaaacggaattccacgagtagcggtgaaatgcgtagatatgtggaagaacaccggtggcgaaggcggttttctatcttattcctgacgctgaggcgcgaaagcaaggggatcaaacagg

SEQ ID NO: 1264 - DNA, 253 bp, Unknown
  Description of Unknown: bacterium polynucleotide
  Chlamydiia; Parachlamydiaceae
tacgtagggtgcaagcattaatcggatttattgggcgtaaagggcgcgtaggcgggagggaaagtcagatgtgaaatcccgaggctcaacctcggacccgcatctgatacttcctttcttgaggatgagcggagaaaatggaattccacgtgtagcggtgaaatgcgtagatatgtggaggaacaccggtggcgaaggcgattttctagcttagacctgacgctgaggcgcgaaagcaaggggagcaaacagg

SEQ ID NO: 1265 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggctggatggaaagtcagatgtgaaatcccggggctcaaccccggaacagcatttgaaacttccattcttgaggataggcggagaaaatggaattccacaagtagcggtgaaatgcgtagatatgtggaagaacaccagtggcgaaggcgattttctagcttatacctgacgctgaggcgcgaaagcaaggggatcaaacagg

SEQ ID NO: 1266 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggccatataagtcagatgtgaaatcccggggctcaaccccggaacagcatttgaaactgtatgactagagggtaggcggagaaaacggaactccacatgtagcggtgaaatgcgtagatatgtggaagaacaccggtggcgaaggcggttttctagcttattcctgacgctgaggcgcgaaagcaaggggatcaaacagg

SEQ ID NO: 1267 - DNA, 253 bp, Unknown
  Description of Unknown: bacterium polynucleotide
  Chlamydiia; Parachlamydiaceae
tacggagggtgcaagcgttaatcggatttattgggcgtaaagggcgcgtaggcggccttataagtcggatgttaaagaccagggctcaaccttggaaaagcaaccgaaactataaggctagaggataggcggagaaaacggaattccacaagtagcggtgaaatgcgtagatatgtggaagaacacccgtggcgaaggcggttttctagcttagacctgacgctaaggcgcgaaagcaaggggatcaaacagg

SEQ ID NO: 1268 - DNA, 253 bp, Unknown
  Description of Unknown: bacterium polynucleotide
  Chlamydiia; Parachlamydiaceae
tacggagggtgcaagcgttaatcggaattactgggcgtaaagggcgcgtaggcggaagtgaaagtcagatgtgaaatcccggggctcaacctcggaacagcatttgaaactcctcttctagagggtaggcggagaaaacggaattccacaagtagcggtgaaatgcgtagatatgtggaagaacaccggtggcgaaggcggttttctagcttattcctgacgctgaggcgcgaaagcaaggggatcaaacagg

SEQ ID NO: 1269 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggaaaggaaagtcagatgtgaaatcccggggctcaacctcggaacagcatatgaaactcccattctagagggtaggcggagaaaacggaattccacaagtagcggtgaaatgcgtagatatgaggaggaataccggcggcgaaggcggccctctggatcgttgctgacgctgagacgcgaaagcgtggggagcaaacagg

SEQ ID NO: 1270 - DNA, 253 bp, Unknown
  Description of Unknown: bacterium polynucleotide
  Chlamydiia; Parachlamydiaceae
tacagagggtgcaagcattaatcggatttattgggcgtaaagagcgcgtaggcgggtctttaagtcagatgtgaaatacccgggctcaacccgggaactgcatttgaaactgaagatcttgagggtagtcggagaaaatggaattccacgtgtagcggtgaaatgcgtagatatgtggaagaacaccggtggcgaaggcgattttctagattatacctgacgctgaggcgcgaaagcaaggggatcaaacagg

SEQ ID NO: 1271 - DNA, 253 bp, Unknown
  Description of Unknown: bacterium polynucleotide
  Chlamydiia; Parachlamydiaceae
tacggagggtgcaagcattaatcggatttactgggcgtaaagggcgcgtaggcggaaaaggaagtcagaggtgaaagcccggggctcaaccccggaacagcatttgaagctcctattctagaggataggcggaggaaacggaattccacaagtagcggtgaaatgcgtagatatgtggaagaacaccggtggcgaaggcggtttcctagcttagacctgacgctgaggcgcgaaagttaggggatcaaacagg

SEQ ID NO: 1272 - DNA, 253 bp, Unknown
  Description of Unknown: bacterium polynucleotide
  Chlamydiia; Parachlamydiaceae
tacggagggtgcgagcattaatcggatttattgggcgtaaagggcgcgtaggcggatagggaagtcagatgtgaaatcccggggcttaacctcggaactgcatttgaaactcccgatctagaggatagatggagaaaatggaattccacaagtagcggtgaaatgcgtagatatgtggaagaacaccagtggcgaaggcgattttctaatttagacctgacgctgatgcgcgaaagctaggggagcaaacagg

SEQ ID NO: 1273 - DNA, 253 bp, Unknown
  Description of Unknown: bacterium polynucleotide
  Chlamydiia; Parachlamydiaceae
gacggagggtgcaagcattaatcggatttattgggcgtaaagggcgcgtaggtgggaagggaagtcatatgtgaaatcccgaagctcaacttcggaactgcatgtgaaactcccattcttgagggtaggcggagaaaatagaattccacaagtagcggtgaaatgcgtagatatgtggaagaatacctgtggcgaaagcgattttctagcttattcctgacactgaggcgcgaaagcaaggggatcaaacagg

SEQ ID NO: 1274 - DNA, 253 bp, Unknown
  Description of Unknown: bacterium polynucleotide
  Chlamydiia; Parachlamydiaceae
tacgtagggtgcaagcattaatcggatttattgggcgtaaagggcgcgtaggcggtaatgaaagtcgaacgtgaaatcccggaactcaacttcggacacgcattcgaaacttcatttctagagggtaggcggagaaaacggaattccacgtgtagcggtgaaatgcgtagatatgtggaagaacacctgtggcgtaggcggttttctagcttattcctgacgctaaggcgcgagagcaaggggagcaaacagg

SEQ ID NO: 1275 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcgggtcagtaagtcagatgtgaaagcccggggctcaaccccggaacagcatttgaaactgcagatctagagggtaggcggagaaaatagaattccacaagtagcggtgaaatgcgtagatatgtggaagaataccagtggcgaaggcggttttctagcttatacctgacgctgaggcgcgaaagcgtggggagcaaacagg

SEQ ID NO: 1276 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggagtgaaaagtcaggtgtgaaatcccggggctcaaccccggaactgcatttgaaactctcaccctagagggtaggcggagaaaacggaattccacaagtagcggtgaaacgcgtagatatgtggaagaacaccggtggcgaaggcggttttctagcttattcctgacgctgaggcgcgaaagcaaggggatcaaacagg

SEQ ID NO: 1277 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggtaatggaagtcagatgtgaaatcccggggctcaaccccggaacagcatttgaaactctatttctagaggattggcggagaaaacggaattccacaagtagcggtgaaatgcgtagagatgtggaagaacaccggtggcgaaggcggttttctagcttattcctgacgctgaggcgcgaaagctaggggagcaaacagg

SEQ ID NO: 1278 - DNA, 253 bp, Unknown
  Description of Unknown: bacterium polynucleotide
  Chlamydiia; Parachlamydiaceae
tacagagggtgcaagcattaatcggatttattgggcgtaaagagcgcgtaggcgggttcttaagtcagatgtgaaatcccggggctcaaccccggaacagcatttgaaactgggaatcttgagggtagtcggagaaaatggaactccacgtgtagcggtgaaatgcgtagatatgtggaagaacaccggtggcgaaggcgattttctagattattcctgacgctgaggcgcgaaagtaaggggatcaaacagg

SEQ ID NO: 1279 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcggaaagataagtcaaatgtgaaatcccggggctcaacctcggacacgcattcgaaactgtctttctagagggtaggcggagaaaacggaattccacgtgtagcggtgaaatgcgtagatatgtggaagaacatctgtggcgaaggcggttttctagcttactcctgacgctgaggcgcgaaagtaaggggatcaaacagg

SEQ ID NO: 1280 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggctggaaggaaagtcagatgtgaaatcccggggctcaaccccggaacagcatttgaaacttcttttctagagggtaggcggagaaaatggaattccacaagtagcggtgaaatgcgtagatatgtggaagaacaccagtggcgaaggcggttttctagcttaaacctgacgctggggcgcgaaagcaaggggatcaaacagg

SEQ ID NO: 1281 - DNA, 253 bp, Unknown
  Description of Unknown: bacterium polynucleotide
  Chlamydiia; Parachlamydiaceae
tacgtagggtgcaagcattaatcggatttattgggcgtaaagggcgcgtaggctggaacgtaagtcagatgtgaaatcccggggctcaaccccggaactgcatttgaaactgtgtttctagagggtaggcggagaaaacggaattccacaagtagcggtgaaatgcgtagatatgtggaagaacaccagtggcgaaggcggttttctagcttatacctgacgctgaggcgcgaaagcaaggggagcaaacagg

SEQ ID NO: 1282 - DNA, 253 bp, Unknown
  Description of Unknown: bacterium polynucleotide
  Chlamydiia; Parachlamydiaceae
tacggagggtgcaagcattaatcggatttattgggcgtaaagggcgcgtaggcgggagggaaagttagttgtgaaagcctgaagcttaacttcagaactgcagctaaaacttcctttctagaggatgagcggagaaaatggaattccacatgtagcggtgaaatgcgtagatatgtggaggaacaccggtggcgaaggcgattttctaacttacacctgacgctgaggcgcgaaagtgaggggagcaaacagg

SEQ ID NO: 1283 - DNA, 253 bp, Unknown
  Description of Unknown: bacterium polynucleotide
  Chlamydiia; Parachlamydiaceae
tacgtagggtgcaagcattaatcggatttattgggcgtaaagggcgtgtaggcggacatataagtcagatgtgaaatcccggagctcaactccggaacagcatttgaaactatatatctagagggtagacggagaaaacggaattccacaagtagcggtgaaatgcgtagatatgtggaagaacaccagtggcgaaggcggttttctagtttatacctgacgctgaggcgcgaaagcaaggggagcaaacagg

SEQ ID NO: 1284 - DNA, 254 bp, Unknown
  Description of Unknown: bacterium polynucleotide
  Chlamydiia; Parachlamydiaceae
tacggagggtgcgagcattaatcggatttattgggcgtaaagggcgcgtaggcgggaatgtaagtcagatgtgaaatcccggggctcaaccccggaacagcatttgaaactgcttttctaagaggatggacggagaaaatggaattccacaagtagcggtgaaatgcgtagatatgtggaagaacaccggtggcgaaggcgattttctagtttagacctgacgctaaagcgcgaaagctaggggagcaaacagg

SEQ ID NO: 1285 - DNA, 253 bp, Unknown
  Description of Unknown: bacterium polynucleotide
  Chlamydiia; Parachlamydiaceae
tacggagggtgcaagcattaatcggatttattgggcgtaaagggggcgtaggcggaaataaaagtcaggcgtgaaattacgaggctcaacctcgtagccgcacctgaaactctatttctagaggatggacggagaaaacggaattccacaagtagcggtgaaatgcgtagatatgtggaagaacacctgtggcgaaggcggttttctagtttagacctgacgctaaggcccgaaagcgaggggagcaaacagg

SEQ ID NO: 1286 - DNA, 253 bp, Unknown
  Description of Unknown: bacterium polynucleotide
  Chlamydiia; Parachlamydiaceae
tacggagggtgctagcattaatcggattcattgggcgtaaagggcgcgtaggcggacttgcaagtcaagtgtgaaatcccggggctcaacctcggaacagcacctgaaactgcaagtatagaggctaggcggagagaacggaattccacaagtagcggtgaaatgcgtagatatgtggaagaacaccggtggcgaaagcggttctctagcttattcctgacgctgaggcgcgaaagcaaggggagcaaacagg

SEQ ID NO: 1287 - DNA, 253 bp, Unknown
  Description of Unknown: bacterium polynucleotide
  Chlamydiia; Parachlamydiaceae
tacgtagggtgcaagcattaatcggatttattgggcgtaaagggcgcgtaggcgggagcgtaagtcagatgtgaaatcccagggctcaaccctggaatagcatctgaaactgcgtttctagagggtaggcggagaaaacagaattccacaagtagcggtgaaatgcgtagatatgtggaagaatacctgtggcgaaggcggttttctagcttatacctgacgctgaggcgcgaaagcaaggggatcaaacagg

SEQ ID NO: 1288 - DNA, 253 bp, Unknown
  Description of Unknown: bacterium polynucleotide
  Chlamydiia; Parachlamydiaceae
tacggagggtgcaagcattaatcggatttactgggcgtaaagggcgcgtaggctggcggataagtcagatgtgaaatcccggggctcaaccccggaacagcatatgaaactatccacctagagggtaggcggagaaaacggaattccacaagtagcggtgaaatgcgtagatatgtggaagaacaccggtggcgaaggcggttttctagcttatacctgacgctgaggcgcgaaagcaaggggagcaaacagg

SEQ ID NO: 1289 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcggaaataaaagtcagatgtgaaatcctggggcttaaccccagaacagcatttgaaactctatttctagagggtaggaggagaaaacggaattccacaagtagcggtgaaatgcgtagatatgtggaagaacaccggtggcgaaggcggttttctatcttattcctgacgctgaggcgcgaaagcaaggggatcaaacagg

SEQ ID NO: 1290 - DNA, 254 bp, Candidatus protochlamydia
  Chlamydiia; Parachlamydiaceae; Candidatus Protochlamydia
tacggagggtgcaagcattaatcggatttattgggcgtaaagagcgcgtaggctgataagtaagtcaggtgtgaaatcctggggctcaaccccagaacagcacttgaaactgctttatctagagggtaggaggagaaaacggaattccacaagtagcggtgaaatgcgtagatatgtggaagaacaccggtggcgaaggcggttttctatcttattcctgacgctgaggcgcgaaagcaaggggatcaaacagg

SEQ ID NO: 1291 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcgggaagattagtcagatgtgaaatcctggggctcaacctcagaactgcatttgaaactgttttcctagaggataggaggagaaaacggaattccacaagtagcggtgaaatgcgtagatatgtggaagaacaccggtggcgaaggcggttttctatcttattcctgacgctaaggcgcgaaagcaaggggatcaaacagg

SEQ ID NO: 1292 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcggggatataagtcagatgtgaaatcctggggctcaacctcagaactgcatttgaaactgtatctctagagggtaggaggagaaaacggaattccacaagtagcggtgaaatgcgtagatatgtggaagaacaccggtggcgaaggcggttttctatcttattcctgacgctgaggcgcgaaagcaaggggatcaaacagg

SEQ ID NO: 1293 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcggggggaaaagtcagatgtgaaatcccggggctcaacctcggaacagcatttgaaactgactccctagagggtaggcggagaaaacggaattccacaagtagcggtgaaatgcgtagatatgtggaagaacaccggtggcgaaggcggttttctagcttattcctgacgctgaggcgcgaaagcaaggggatcaaacagg

SEQ ID NO: 1294 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcggtcttgcaagtcagatgtgaaatttcggggctcaaccccggagctgcatttgaaactacaggactagagggtagtcggagaaaacggaattccacaagtagcggtgaaatgcgtagatatgtggaagaacaccggtggcgaaggcggttttctagattattcctgacgctaaagcgcgaaagcaaggggatcaaacagg

SEQ ID NO: 1295 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcggaaatataagtcaggtgtgaaatcccggggctcaaccccggaactgcatttgaaactgtatatctagagggtaggcggagaaaacggaattccacaagtagcggtgaaatgcgtagatatgtggaagaacaccggtggcgaaggcggttttctagcttattcctgacgctaatgcgcgaaagcaaggggatcaaacagg

SEQ ID NO: 1296 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcggtaagaaaagtcagatgtgaaatcctggggctcaacctcagaacagcatttgaaactgtctttctagagggtaggcggagaaaacggaattccacaagtagcggtgaaatgcgtagatatgtggaagaacaccggtggcgaaggcggttttctagcttatacctgacgctgaggcgcgaaagcaaggggatcaaacagg

SEQ ID NO: 1297 - DNA, 253 bp, Candidatus protochlamydia
  Chlamydiia; Parachlamydiaceae; Candidatus Protochlamydia
tacagagggtgcaagcgttaatcggatttattgggcgtaaagggcgcgtaggcggggataaaagtcagatgtgaaatcccggggctcaacctcggaactgcatttgaaactctatctctagagggtaggcggagaaaacggaattccacaagtagcggtgaaatgcgtagatatgtggaagaacaccggtggcgaaggcggttttctagcttattcctgacgctgaggcgcgaaagcaaggggatcaaacagg

SEQ ID NO: 1298 - DNA, 253 bp, Candidatus protochlamydia
  Chlamydiia; Parachlamydiaceae; Candidatus Protochlamydia
tacggagggtgcaagcattaatcggagttattgggcgtaaagggcgcgtagacggtaagaatagtcagatgtgaaatttcggggctcaaccccgaagctgcatttgaaactgtctttctagaggataggcggggaaaacggaattccacaagtagcggtgaaatgcgtagatatgtggaagaacaccggtggcgaaggcggttttctagcttattcctgacgctgaggcgcgaaagcaaggggatcaaacagg

SEQ ID NO: 1299 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcggagatgaaagtcagatgtgatatcctggggctcaacctcagaactgcatttgaaactgtatctctagagggtagtcggagaaaacggaattccacaagtagcggtgaaatgcgtagatatgtggaagaacaccggtggcgaaggcggttttctagattagacctgacgctgaggcgcgaaagcaaggggatcaaacagg

SEQ ID NO: 1300 - DNA, 253 bp, Candidatus protochlamydia
  Chlamydiia; Parachlamydiaceae; Candidatus Protochlamydia
tacggagggtgcaagcattaatcggatttattgggcgtaaagggcgcgtaggcggggatgtaagtcagatgtgaaatcccggggctcaacctcggaactgcatttgaaactatatctcttgaggatagaaggagaaaacggaattccacaagtagcggtgaaatgcgtagatatgtggaagaacaccggtggcgaaggcggttttctattttattcctgacgctgatgcgcgaaagcaaggggatcaaacagg

SEQ ID NO: 1301 - DNA, 254 bp, Candidatus protochlamydia
  Chlamydiia; Parachlamydiaceae; Candidatus Protochlamydia
tacggagggtgcaagcattaatcggatttattgggcgtaaagggcgcgtaggcggctatgtaagtcagatgtgaaatttccgagctcaactcggaacccgcatttgaaactacattatctagagggtaggcggagaaaacggaattccacaagtagcggtgaaatgcgtagatatgtggaagaacaccggtggcgaaggcggtcttctagcttattcctgacgctgaagcgcgaaagcaaggggatcaaacagg

SEQ ID NO: 1302 - DNA, 253 bp, Parachlamydia sp.
  Chlamydiia; Parachlamydiaceae; Parachlamydia
tacggagggtgcaagcattaatcggatttattgggcgtaaaggacgcgtaggcggtaaggtaagtcgggtgtgaaatcccggggctcaaccccggaacagcacatgaaactgcctttctagagggtaggcggagaaaacggaattccacaagtagcggtgaaatgcgtagatatgtggaagaacacctgtggcgaaagcggttttctagcttactcctgacgctgaggcgtgaaagcaaggggagcaaacagg

SEQ ID NO: 1303 - DNA, 253 bp, Parachlamydia sp.
  Chlamydiia; Parachlamydiaceae; Parachlamydia
tacggagggtgcaagcattaatcggacttattgggcgtaaagggcgcgtaggcggggatgtaagtcagatgtgaaatcccgaggctcaacctcggaacagcatttgaaactccatcccttgaggataggcggagaaaacggaattccacatgtagcggtgaaatgcgtagatatgtggaagaacatcggtggcgaaggcggttttctagcttaaacctgacgctgaggcgcgaaagcaaggggatcaaacagg

SEQ ID NO: 1304 - DNA, 253 bp, Parachlamydia sp.
  Chlamydiia; Parachlamydiaceae; Parachlamydia
tacggagggtgcaagcattaatcggatttattgggcataaagggcgcgtaggcggaccagcaagtcagatgtgaaatcccggggctcaaccccggaacagcatttgaaactcctggtctagagggtaggcggggaaaacggaattccacaagtagcggtgaaatgcgtagatatgtggaagaacatcggtggcgaaggcggttttctagcttattcctgacgctgaggcgcgaaagcaaggggatcaaacagg

SEQ ID NO: 1305 - DNA, 253 bp, Parachlamydia sp.
  Chlamydiia; Parachlamydiaceae; Parachlamydia
tacggagggtgcaagcattaatcggatttattgggcgtaaagggcgcgtaggcgggcaaataagtcagatgtgaaatcctggagctcaactccagaacagcatttgaaactatttatcttgagggtaggcggagaaaatggaattccacaagtagcggtgaaatgcgtagatatgtggaagaacaccagtggcgaaggcggttttctagcttactcctgacgctgaggcgcgaaagcaaggggatcaaacagg

SEQ ID NO: 1306 - DNA, 253 bp, Candidatus rhabdochlamydia
  Chlamydiia; Rhabdochlamydiaceae; Candidatus Rhabdochlamydia
tacagagggtgcgagcgttaatcggaattattgggcgtaaagggcgcgtaggcggaacgataagtcagatgtgaaataccaaagctcaactttggtgctgcatttgaaactatcgatctagagggttgacggagaaaacggaattccacgtgtagcggtgaaatgcgtagatatgtggaagaacaccagtggcgaaagcggttttctagttaatacctgacgctgaggcgcgagagcaaggggatcaaacagg

SEQ ID NO: 1307 - DNA, 253 bp, Candidatus rhabdochlamydia
  Chlamydiia; Rhabdochlamydiaceae; Candidatus Rhabdochlamydia
tacgtagggtgcaagcattaatcggatttattgggcgtaaagggcgcgtaggcgggtttataagtcgggtgtgaaattccgagactcaatttcggagctgcatctgaaactatagatctagaggttcggcggagaaaatggaattccacatgtagcggtgaaatgcgtggatatgtggaggaacaccggtggcgaaagcggttttctagctgacacctgacgctgatgcgcgagagcaaggggagcaaacagg

SEQ ID NO: 1308 - DNA, 253 bp, Candidatus rhabdochlamydia
  Chlamydiia; Rhabdochlamydiaceae; Candidatus Rhabdochlamydia
tacggagggtgcaagcattaatcggaattattgggcgtaaagggcgcgtaggcggaattgtaagtcagatgtgaaataccgaggcttaacttcggtgctgcatttgaaactacaaatctagaggatagacggagaaaacggaattccacgtgtagcggtgaaatgcgtggatatgtggaagaacacctgtggcgaaagcggttttctagtttattcctgacgctgaggcgcgagagcaaggggagcaaacagg

SEQ ID NO: 1309 - DNA, 253 bp, Candidatus rhabdochlamydia
  Chlamydiia; Rhabdochlamydiaceae; Candidatus Rhabdochlamydia
tacggagggtgcaagcattaatcggaattattgggcgtaaagggcgcgtaggcgggtttataagtcagatgtgaaattccgaaactcaatttcggagctgcatttgaaactgtaagtcttgatggatggcggagaaaacggaattccacgtgtagcggtgaaatgcgtagatatgtggaagaacacctgtggcgaaagcggttttctagctataacctgacgctgaggcgcgagagcaaggggagcaaacagg

SEQ ID NO: 1310 - DNA, 253 bp, Candidatus rhabdochlamydia
  Chlamydiia; Rhabdochlamydiaceae; Candidatus Rhabdochlamydia
tacggagggtgcaagcattaatcggaattattgggcgtaaagggcgcgtaggcggatgtataagtcagatgtgaaattccggaactcaattccggagctgcatttgaaactgtagatctagagggatggcggagaaaacggaattccacgtgtagcggtgaaatgcgtagatatgtggaagaacacctgtggcgaaagcggttttctagctataacctgacgctgaggcgcgagagcaaggggagcaaacagg

SEQ ID NO: 1311 - DNA, 253 bp, Candidatus rhabdochlamydia
  Chlamydiia; Rhabdochlamydiaceae; Candidatus Rhabdochlamydia
tacggagggtgcaagcattaatcggatttattgggcgtaaagggcgcgtaggcggaagaacaagtcaggtgtgaaattccgaagcccaacttcggagctgcacttgaaactgttcatctagaggattggcggagaaaacggaattccacgagtagcggtgaaatgcgtagatatgtggaagaacaccggtggcgaaagcggttttctagcttattcctgacgctgaggcgcgagagcaaggggagcaaacagg

SEQ ID NO: 1312 - DNA, 253 bp, Candidatus rhabdochlamydia
  Chlamydiia; Rhabdochlamydiaceae; Candidatus Rhabdochlamydia
tacggagagcgcaagcattaatcggaattattgggcgtaaagggcgcgtaggcggaaaggtaagtcagatgtgaaattccgaagctcaacttcggagctgcatttgaaactgccattctagagggttgacggagaaaacggaattccacgtgtagcggtgaaatgcgtagatatgtggaagaacaccagtggcgaaagcggttttctagtttatacctgacgctgaggcgcgagagcaaggggagcaaacagg

SEQ ID NO: 1313 - DNA, 253 bp, Candidatus rhabdochlamydia
  Chlamydiia; Rhabdochlamydiaceae; Candidatus Rhabdochlamydia
tacgtagggtgcaagcattaatcggatttattgggcgtaaagggcgcgtaggcgggtttgaaagtcagatgtgaaattccgaagctcaacttcggagctgcatttgaaactccagatctagaggaatggcggggaaaatggaattgcacgtgtagcggtgaaatgcgtagatatgtggaagaacacctgtggcgaaagcggttttctagctttctcctgacgctgaggcgcgagagcaaggggagcaaacagg

SEQ ID NO: 1314 - DNA, 253 bp, Candidatus rhabdochlamydia
  Chlamydiia; Rhabdochlamydiaceae; Candidatus Rhabdochlamydia
tacggagagtgcaagcattaatcggaattattgggcgtaaagggcgcgtaggcgggatgataagtcagatgtgaaattctgaagctcaacttcagagctgcatttgaaactataattctcgaggattgacggagaaaacggaattccacgtgtagcggtgaaatgcgtagatatgtggaagaacacctgtggcgaaagcggttttctagtttatacctgacgctgaggcgcgagagcaaggggagcaaacagg

SEQ ID NO: 1315 - DNA, 253 bp, Unknown
  Description of Unknown: bacterium polynucleotide
  Chloroflexi
gacagagggggcaagcgttgtccggatttactgggcgtacagcgcgcgcaggcggcccgataggaacccggtgacagtctcccgctcaatgggaggaggtctgggttgaccggcgggctagaggccgtgagagggtgatggaacgcccggtggagcggtgaaatgcgtagagatcgggcagaacaccagtggggaagccggtcacctggcacggacctgacgctgaggcgcgacagcgtggggagcaaatggg

SEQ ID NO: 1316 - DNA, 252 bp, Unknown
  Description of Unknown: bacterium polynucleotide
  Chloroflexi
tacggaggagccaagcgttgtccggattgactgggcgtaaagcgcacgcaggtggtcgtgcaagtgtcgtgtgaaagcagctcgctcaacgagctgaggcatggcagactgtacaactcgagaccgtgagaggtcggtggaattgccggtgtagtggtgaaatgcgtagagatcggcaggaacacccaaggggaagccagccgactggcacggtgctgacactgaggtgcgagagcgtggggagcgaaccgg

SEQ ID NO: 1317 - DNA, 253 bp, Unknown
  Description of Unknown: bacterium polynucleotide
  Chloroflexi
tacgtagggggcaagcgttgtccggacttactgggcgtaaagcgcgtgcaggcggattggtatgtgccgtgtgaaagctcccagcttgcctgggagaggtcgcggtagacagtcgatctggaggctcggagaggttagtggaattcccggtgtagtggtgaaatgcgtagatatcgggaggaacaccagtggcgcaagcggctaactggccgagacctgacgctgagacgcgacggcgtggggagcaaaccgg

SEQ ID NO: 1318 - DNA, 253 bp, Unknown
  Description of Unknown: bacterium polynucleotide
  Chloroflexi
tacagagggggcaagcgttgtccggagttactgggcgtaaagggtccgcaggcggcacgtcaagtgctgtgtgaaagccccgtgcttaacacggggaggccacggcagactgtcgcgctcgagccatgcagagggtggtggaattgccggtgtagtggtgaaatgcgtagagatcggcaggaacacccagggcgaaagcagccacctgggcatgcgctgacgctgagggacgaaagcgtggggagcgaaccgg

SEQ ID NO: 1319 - DNA, 253 bp, Unknown
  Description of Unknown: bacterium polynucleotide
  Chloroflexi
gacagaggaggcaagcgttgtccggactgactgggcgtaaagcgtccgcaggtggtcgtgcaagtgcgctgtgaaagcggcccgctcaacgggccgaggccagcgcagactgctcgactggaggtcgggagaggtcggtggaattgccggtgtagtggtgaaatgcgtagagatcggcaggaacacccaaggggaagccagccgactggcccgcacctgacactcagggacgacagcgtggggagcgaaccgg

SEQ ID NO: 1320 - DNA, 253 bp, Unknown
  Description of Unknown: bacterium polynucleotide
  Chloroflexi
gacagaggaggcaagcgttgtccggacttactgggcgtaaagcgtccgcaggtggtcgtgcaagcgcgctgtgaaagcactcggcttaactgagtgaggccaatgcagactgctcgactggaggccgggagaggtcggtggaattgccggtgtagtggtgaaatgcgtagagatcggcaggaacacccaaggggaagccagctgactggcccggtcctgacactcagggacgacagcgtggggagcgaaccgg

SEQ ID NO: 1321 - DNA, 253 bp, Unknown
  Description of Unknown: bacterium polynucleotide
  Chloroflexi
gacagaggaggcaagcgttgtccggattgactgggcgtaaagcgtccgcaggtggcatgccaagtggggtgtgaaagccggtggcttaactgccggaggccatcccaaactggcgcgctggagccgggcagagggtgacggaattgccggtgtagtagtgaaatgcgtagagatcggcaggaagaccaagggggaagccagtcacctgggcccgtgctgacactcatgggcgaccgcgtggggggcgaaccgg

SEQ ID NO: 1322 - DNA, 253 bp, Unknown
  Description of Unknown: bacterium polynucleotide
  Chloroflexi
gacagagggggcaagcgttgtccggaattactgggcgtacagggcacgcaggtggctgcataggtggcgtgtgaaagccccgcgcttaacgcggggaggccacgccaaacggtgcggctcgagcgatgcagagggtggtggaattgccggagtagtggtgaaatgcgtagagatcggcaggaacaccaaggacgaaggtaaccacctgggcatcagctgacactcatgtgcgacagcgtggggagcgaacagg

SEQ ID NO: 1323 - DNA, 253 bp, Unknown
  Description of Unknown: bacterium polynucleotide
  Chloroflexi
tacgtaggggtcgagcgttgtccggacttactgggcgtaaagcgtgggtaggtggtcggtgatgtgccgtgtgaaaacgccgcgcttctcgcggcgaggtcgcggtagacacaccgactagaggcacggaggggggcgtagaattcccggtgtagtggtgaaatgcgtagatatcgggaggaataccagtggcgcaagcggcgccctggccgtgacctgacactgagccacgacggcgtggggagcaaacggg

SEQ ID NO: 1324 - DNA, 253 bp, Unknown
  Description of Unknown: bacterium polynucleotide
  Chloroflexi
tacagagggggcaagcgttgtccggatttactgggcgtacagcgcgcgcaggtggtcagctatgtgccgtgtgacaagcggaggcttaacctccgagggccacggtagacaggcggactagaggcagggagagggtcgtggaatacccggtggagcggtgaaatgcgtagagatcgggtggaacaccagcggcgaaggcggcccactggatcggtactgacgctgaggtgcgaaagcgtggggagcaaacagg

SEQ ID NO: 1325 - DNA, 254 bp, Unknown
  Description of Unknown: bacterium polynucleotide
  Chloroflexi
tacagagggggcaagcgttgtccggattgactgggcgtaaagcgcacgtaggtggttggttacgtggtgtgtgaaagctcagggcttaaccctgataggccatgccaaacgaaccgactcgaggctgagcagaggcgggtggtattgccggtgtagtggtgaaatgcgtagagatcggcaggaacaccaagggggaacccagcccgctgggccagtcctgacactgaggtgcgacagcgtggggagcgaacagg

SEQ ID NO: 1326 - DNA, 253 bp, Unknown
  Description of Unknown: bacterium polynucleotide
  Chloroflexi
tacagagggggcaagcgttgtccggactgactgggcgtaaagcgcacgcaggcggttgtgggcgtcggtgctgaaagtccactgcttaacagtgggatgcgtgccgatacgccataactggagcgatgcagaggccagtggaattgccggagtagtggtgaaatgcgtagagatcggcaggaacacccaaggggaagccagctggctgggcatttgctgacgctcatgtgcgacagcgtggggagcgaactgg

SEQ ID NO: 1327 - DNA, 253 bp, Unknown
  Description of Unknown: bacterium polynucleotide
  Chloroflexi
tacagagggggcaagcgttgtccggatttactgggcgtacagcgcgcgcaggcggccacgtatgtgaccggtgacatcctcgggctcaacccgaggcggcccggttacacagcgcggctggaggcagggagagggatgtggaatacccggtggagcggtgaaatgcgtagagatcgggtggaacaccagcggcgaaggcggcatcctggccctgacctgacgctgaggcgcgatagcgtggggagcaaacggg

SEQ ID NO: 1328 - DNA, 253 bp, Unknown
  Description of Unknown: bacterium polynucleotide
  Chloroflexi
tacagagggggcaagcgttatccggattgactgggcgtaaagcgtctgtaggtggcaacgtaggtggggtgtaacatctcccggcttaaccgggagcggccgctccaaaccacgtcgcttgagtcgtgcagaggtcggtggaattgccggtgtagtggtgaaatgcgtagagatcggcaggaacaccaagggcgtaagcagccgactgggcacggactgacactgagggacgaaagcgtggggagcgaaccgg

SEQ ID NO: 1329 - DNA, 253 bp, Unknown
  Description of Unknown: bacterium polynucleotide
  Chloroflexi
tacagagggggcaagcgttgtccggaattactgggcgtacagcgcgcgcaggcggaccgccgcgtgccgtgtgacaagccaccgctcaacggtggagggccagggtacacgagcggtctggaggcagggagagggatgtggaatgcccggtggagcggtgaaatgcgtagagatcgggcggaacaccagcggcgaaggcggcatcctggtcctgttctgacgctgaggcgcgagagcgtggggagcaaactgg

SEQ ID NO: 1330 - DNA, 253 bp, Unknown
  Description of Unknown: bacterium polynucleotide
  Chloroflexi; Kouleothrixaceae
gacagaggagccgagcgttgtccggattgactgggcgtaaagcgcacgcaggtggtgatgcaagtgccgtgtgaaagccggtggcttaactgccggaggccatagcagactgcctcacttgagcccgagagaggtccgtggaattgccggtgtagtggtgaaatgcgtagagatcggcaggaacacccaaggagaaatcagcggactggctcggtgctgacactgaggtgcgaaagcgtggggagcgaacggg

SEQ ID NO: 1331 - DNA, 253 bp, Unknown
  Description of Unknown: bacterium polynucleotide
  Chloroflexi; Kouleothrixaceae
tacagaggtcccaagcgttgttcggattcactgggcgtaaagcgcacgcaggcggacgcgcgcgtggggtgtgaaatctggccgcttaacggccaggcgccatcccatacggcgcgtctggagtgatgcagaggtcggtggaattgccggtgtagtggtgaaatgcgtagagatcggcaggaacacccagggggaaaccagccgactgggcatctactgacgctgaggtgcgagagcgtggggagcgaaccgg

SEQ ID NO: 1332 - DNA, 253 bp, Unknown
  Description of Unknown: bacterium polynucleotide
  Chloroflexi; Kouleothrixaceae
tacagaggagccaagcgttgtccggattgactgggcgtaaagcgcacgcaggcggtcgcgcgcgtggggtgtgaaatctggccgcttaacggccaggcgccatcccatacggcgtgactggagggctgcagaggtcgatggaattgccggtgtagtggtgaaatgcgtagagatcggcaggaacacccaggggggaaccagtcgactgggcagcacctgacgctgaggtgcgagagcgtggggagcgaaccgg

SEQ ID NO: 1333 - DNA, 253 bp, Unknown
  Description of Unknown: bacterium polynucleotide
  Chloroflexi; Kouleothrixaceae
gacagaggagccaagcgttgtccggattgactgggcgtaaagcgcacgcaggcggcccaatacgtggggtgtgaaagctggcggcttaactgccagatgccatcccatacggctgggctcgagccatgcagaggtccacggaattgccggtgtagtggtgaaatgcgtagagatcggcaggaacacccagggggaaaccagtggactgggcatgagctgacgctcaggtgcgaaagcgtggggagcgaaccgg

SEQ ID NO: 1334 - DNA, 253 bp, Unknown
  Description of Unknown: bacterium polynucleotide
  Chloroflexi; Roseiflexaceae
gacagagggggcaagcgttgtccggaattactgggcgtaaagcgcacgcaggcggcccggcaagtggtgtgtgacagcgaacggcttaaccgtccgaggccatgccagactgccgagcttgagccgtgcagaggccagtggaattgccggtgtaggagtgacatccgtagagaccggcaggagcaccgatggggaagccagctggctgggcacgcgctgacgctcaggtgcgatagcgtggggagcaaaccgg

SEQ ID NO: 1335 - DNA, 253 bp, Unknown
  Description of Unknown: bacterium polynucleotide
  Chloroflexi; Chloroflexaceae
tacggagggggcaagcgttgtccggacttactgggcgtaaagggtgcgtaggcggtcttgtgcgtcggtgctgaaagcgcccggcttaaccgggcgaggcgtgccgatacgacgagactagaggggcagcgagggtggcggaactcctggtgtagtggtgaaatgcgtagagatcaggaagaacacccgtggcgcaagcggccacctggctgccaactgacgctgaggcacgagagcgtggggagcgaaccgg

SEQ ID NO: 1336 - DNA, 253 bp, Unknown
  Description of Unknown: bacterium polynucleotide
  Chloroflexi; Chloroflexaceae
tacggagggggcaagcgttgtccggacttactgggcgtaaagggtgcgtaggcggcctgctgcgtcggtgctgaaagcgcccggcttaaccgggcgaggcgtgccgatacgagttggctggagccttggtgagggtggcggaactcctggtgtagtggtgaaatgcgtagagatcaggaagaacacccgtggcgcaagcggccacctggccaagagctgacgctgaggcacgagagcgtggggagcgaaccgg

SEQ ID NO: 1337 - DNA, 253 bp, Chloroflexus sp.
  Chloroflexi; Chloroflexaceae; Chloroflexus
gacagagggggcaagcattgtccggagttactgggcgtaaagggcgcgcaggcggtgggctgcgtcggcgctgaaagcgccccgcttaacggggcgaggcgcgccgatacgagtccactcgaggcaagcagagggtggcggaattccgggtggagcggtgaaatgcgtagagatccggaggaacgccggtggggaagccggccacctgggcttgacctgacgctgcggcgcgacagcgtggggagcaaaccgg

SEQ ID NO: 1338 - DNA, 253 bp, Chloronema sp.
  Chloroflexi; Chloroflexaceae; Chloronema
gacggagggggcaagcgttgtccggaatcactgggcgtaaagcgcgcgtaggtggcacagtgcgtcggtgctgaaagcgccgggcttaacccggcgaggtgcagcgatacgactgagctcgaggccagcagagggtggcggaattccgggtgtagtggtgaaatgcgtagagatccggaggaacgccggtggtgaagacggccacctgggctggacctgacactgaggtgcgacagcgtggggagcgaacagg

SEQ ID NO: 1339 - DNA, 253 bp, Chloronema sp.
  Chloroflexi; Chloroflexaceae; Chloronema
gacggagggggcaagcgttgtccggaatcactgggcgtaaagcgcacgtaggtggtctggtgcgtcggcgctgaaagctctgggctcaacccagcgaggcgtgccgatacgaccggacttgaggcagggagagggtagcggaattccgggtgtagtggtgaaatgcgtagagctccggaggaacgcctgaagcgaaagcggctacctggccctggcctgacactgaggtgcgaaagcgtggggagcgaaccgg

SEQ ID NO: 1340 - DNA, 253 bp, Chloronema sp.
  Chloroflexi; Chloroflexaceae; Chloronema
gacggagggggcaagcgttgtccggaatcactgggcgtaaagcgcacgtaggttgtcgtgtgcgtcgatgctgaaagcgccgggcttaacccggcgaggtgcagcgatacgacacgactggaggcagggagagggtggcggaattccgggtgtagtggtgaaatgcgtagagatccggaggaacgccagtgacgaaggtggccacctggccctgacctgacactgagatgcgacagcgtggggagcgaaccgg

SEQ ID NO: 1341 - DNA, 253 bp, Unknown
  Description of Unknown: bacterium polynucleotide
  Chthonomonadetes
tacggagggggcgagcgttgtccgaagttactgggcgtaaagcgcgcgtaggcggggaggcaagtccgctgtgaaagcctgaggctcaacctcagcgggtcggtggatactgcctctcttgaaggcgttagggggagatggaattaccggtgtagcggtgaaatgcgtagatatcggtaggaacaccagtggcgaaggcggtctcctgggacgttcttgacgctgaggcgcgaaagctgggggagcgaacggg

SEQ ID NO: 1342 - DNA, 253 bp, Unknown
  Description of Unknown: bacterium polynucleotide
  Chthonomonadetes; Chthonomonadaceae
tgcggagggggctagcgttgtccgaagttactgggcgtaaagcgcgcgtaggcgggttggtaagtccgctgtgaaagcccggagcttaactccggagggtcggtggatactgccagtcttgaaggtgctagggggagatggaattaccggtgtagcggtgaaatgcgtagatatcggtaggaacaccagtggcgaaggcggtctcctggggcattcttgacgctgaggcgcgaaagctgggggagcaaacggg

SEQ ID NO: 1343 - DNA, 253 bp, Unknown
  Description of Unknown: bacterium polynucleotide
  Chthonomonadetes; Chthonomonadaceae
tacggggggggcgagcgttgtccgaagttactgggcgtaaagcgcgtgtaggcgggttgttaagtccgctgtgaaagcccggtgctcaacgccggagggtcggtggatactggcagtcttgaagtggctagggggaaatggaattaccggtgtagcggtgaaatgcgtagatatcggtaggaacaccagtggcgaaggcggtttcctggagcccacttgacgctgagacgcgaaagctgggggagcaaacggg

SEQ ID NO: 1344 - DNA, 253 bp, Unknown
  Description of Unknown: bacterium polynucleotide
  Clostridia
tacgtagggggcgagcgttgtccggaattactgggcgtaaagggagcgtaggcggcctgtcgtgtcctgcgtgaaagtcgtcggcttaaccgacggaggtcgcaggaaactggcgggcttgagtgccggagagggtggcggaattcccggtgtagcggtgaaatgcgtagatatcgggaggaacaccagtggcgaaggcgactacctggactgatactgacactgaggtgcgaaagcgtggggagcaaacagg

SEQ ID NO: 1345 - DNA, 253 bp, Unknown
  Description of Unknown: bacterium polynucleotide
  Clostridia
tacgtagatggcgagcgttatccggaatgactgggcgtaaagggtgcgtaggcggtttaataagtcagatgtgaaagtcccgagcttaacttggggattgcatttgaaactattagacttgagtgcgggagaggaaagtggaattcctagtgtagcggtgaaatgcgtagatattaggaggaacaccagtggcgaaggcgactttctggaccgtaactgacgctgaggcacgaaagcgtggggagcaaacagg

SEQ ID NO: 1346 - DNA, 253 bp, Unknown
  Description of Unknown: bacterium polynucleotide
  Clostridia
tacgtaggtggcgagcgttgtccggaattactgggcgtaaagggcgagtaggcggttttacaagtcagatgtgaaatgcatgggctcaacccatgaactgcatttgaaactgtaagacttgagtgcggtagaggaaagtggaattcccagtgtagcggtgaaatgcgtagatattgggaggaacaccagtggcgaaggcgactttctgggccgtaactgacgctgaggcgcgaaagcgtggggagcaaacagg

SEQ ID NO: 1347 - DNA, 253 bp, Unknown
  Description of Unknown: bacterium polynucleotide
  Clostridia
tacgtagggggcgagcgttgtccggaattactgggcgtaaagggtgcgtaggcggctgcttaagtcagatgtgaaagaccacagcttaactgtggggttgcatttgaaactgggtggcttgagtgtcggagagggtagtggaattcccggtgtagcggtgaaatgcgtagatatcgggaggaacaccagtggcgaaggcgactacctggacgataactgacgctgaggcacgaaagctaggggagcaaacagg

SEQ ID NO: 1348 - DNA, 253 bp, Unknown
  Description of Unknown: bacterium polynucleotide
  Clostridia
tacgtagggggcgagcgttgtccggaatcactgggcgtaaagggtgcgtaggcggcttggcaagtcctgtgtgaaaggtcgcggctcaaccgcggtgggtcatgggaaactgccaagctcgagtgccggagaggatagcggaattcccggtgtagcggtgaaatgcgtagagatcgggaggaacaccagtggcgaaggcggctatctggaaggtcactgacgctgaggcacgacagctgggggagcaaacagg

SEQ ID NO: 1349 - DNA, 253 bp, Unknown
  Description of Unknown: bacterium polynucleotide
  Clostridia
tacgtaggtggcaagcgttgtccggaattactgggcgtaaagcgcgcgtagacggcttaataagtcagatgtgaaagacccgggctcaacccgggggttgcatctgagactgctaagcttgagtgcaggagaggcaagtggaattcccagtgtagcagtgaaatgcgtagatattgggaggaacaccagtggcgaaggcgacttgctggactgtaactgacgttgaggtgcgaaagctaggggagcaaacggg

SEQ ID NO: 1350 - DNA, 253 bp, Unknown
  Description of Unknown: bacterium polynucleotide
  Clostridia
tacgtagggggcgagcgttgtccggaattactgggcgtaaagggtgcgtaggcggccctttaagtcgggtgtgaaagtccacggcttaaccgtgggattgcactcgaaactggagggcttgagtgtcggagagggtagtggaattcccggtgtagcggtgaaatgcgtagatatcgggaggaacaccagtggcgaaggcgactacctggacgataactgacgctgaggcacgaaagctaggggagcaaacagg

SEQ ID NO: 1351 - DNA, 253 bp, Unknown
  Description of Unknown: bacterium polynucleotide
  Clostridia; Tissierellaceae; 24838
tacgtatggggcgagcgttgtccggaattattgggcgtaaagggtacgcaggcggtttaccaagttggatgtgaaatcttgtagctcaactacaaacgtgcatccaaaactggctaacttgagttaaggagaggtaagtggaattcctggtgtagcggtggaatgcgtagatatcaggaggaataccggtggcgaaggcgacttactggacttaaactgacgctgaggtacgaaagcgtggggagcaaacagg

SEQ ID NO: 1352 - DNA, 253 bp, Unknown
  Description of Unknown: bacterium polynucleotide
  Clostridia; Tissierellaceae; 24838
tacgtatggagcgagcgttgtccggaattattgggcgtaaagggtgcgcaggcggctttacaagttggatgtgaaatattgtggctcaaccacaaacgtgcatccaaaactgcaaagcttgagttaaggagaggtaagtggaattcctggtgtagcggtggaatgcgtagatatcaggaggaataccggtggcgaaggcgacttactggacttaaactgacgctcaggcacgaaagcgtggggagcaaacagg

SEQ ID NO: 1353 - DNA, 252 bp, Anaerococcus sp.
  Clostridia; Tissierellaceae; Anaerococcus
tacgtaaggaccgagcgttgtccggaatcattgggcgtaaagggtacgtaggcgggtcattaagttagaagtcaaaggctatagctcaactatagtaagcttctaaaactggagaccttgagtaatggaagggaaagtggaattcctagtgtagcggtggaatgcgcagatattaggaggaataccggtggctaaggcgactttctggccattaactgacgctgaggtacgaaagcgtgggtagcaaacagg

SEQ ID NO: 1354 - DNA, 252 bp, Finegoldia sp.
  Clostridia; Tissierellaceae; Finegoldia
tacgtatggagcgagcgttgtccggaattattgggcgtaaagggtacgcaggcggtttaataagtcgaatgttaaagatcggggctcaaccccgtaaagcattggaaactgataaacttgagtagaggagaggaaagtggaattcctagtgtagtggtgaaatacgtagatattaggaggaataccagtagcgaaggcgactttctggacacaaactgacgctgaggtacgaaagcgtggggagcaaacagg

SEQ ID NO: 1355 - DNA, 252 bp, Peptoniphilus sp.
  Clostridia; Tissierellaceae; Peptoniphilus
tacgtagggggctagcgttgtccggaatcactgggcgtaaagggttcgcaggcggaaatgcaagtcaggtgtaaaaggcagtagcttaactactgtaagcatttgaaactgcatatcttgagaagagtagaggtaagtggaatttttagtgtagcggtgaaatgcgtagatattaaaaagaataccggtggcgaaggcgacttactgggctcattctgacgctgaggaacgaaagcgtgggtagcaaacagg

SEQ ID NO: 1356 - DNA, 253 bp, Peptoniphilus sp.
  Clostridia; Tissierellaceae; Peptoniphilus
tacgtagggggctagcgttgtccggaatcactgggcgtaaagggttcgcaggcggaataacaagtcagatgtgaaaggcatgggctcaacccatgtaagcatttgaaactgtaattcttgagaagtggagaggtaagtggaattcctagtgtagcggtgaaatgcgtagatattaggaggaatacctgtggcgaaggcgacttactggacacaaatctgacggcgaggaacgaaagcgtgggtagcaaacagg

SEQ ID NO: 1357 - DNA, 253 bp, Unknown
  Description of Unknown: bacterium polynucleotide
  Clostridia; Tissierellaceae; WAL_1855D
tacgtaaggggcgagcgttgtccggaattattgggcgtaaagagtgcgtaggcggcaaattaagtcagatgtgaaaactaagggctcaacccatagattgcatctgaaactgatatgcttgagtcaaggagaggaaagtggaattcctagtgtagcggtggaatgcgtagatattaggaggaataccggtggctaaggcgactttctggacttgaactgacgctgaggcacgaaagcgtggggagcaaacagg

SEQ ID NO: 1358 - DNA, 253 bp, Caldicellulosiruptor saccharolyticus
  Clostridia; Caldicellulosiruptoraceae; Caldicellulosiruptor saccharolyticus
tacgtaggtggcgagcgttgtccggaattactgggcgtaaagggtgcgtaggcggcctggtaagttgagcgtgaaatttttgggctcaacccaaaaggagcgctcaatactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacagg

SEQ ID NO: 1359 - DNA, 253 bp, Carboxydocella sp.
  Clostridia; Carboxydocellaceae; Carboxydocella
aacgtagggggcgagcgttatccggaattactgggcgtaaagcgcgtgtaggcgggctgttaagtcggttgtgaaaatccggggctcaactccggacatgcagccgatactgacagtcttgagggcaggagagggaagcggaattcccggtgtagcggtgaaatgcgtagatatcgggaggaacaccagtggcgaaggcggctttctggactgtacctgacgctgagacgcgaaagcgtggggagcaaacagg

SEQ ID NO: 1360 - DNA, 253 bp, Unknown
  Description of Unknown: bacterium polynucleotide
  Clostridia; Clostridiaceae
tacgtaggtggcaagcgttgtccggatttactgggcgtaaagggagcgtaggcggacttttaagtgggatgtgaaatacccgggcttaacctgggtgctgcattccaaactgggagtctagagtgcaggaggggaaagtggaattcctagtgtagcggtgaaatgcgtagagattaggaagaacaccagtggcgaaggcgactttctggactgtaactgacgctgaggctcgaaagcgtggggagcgaacagg

SEQ ID NO: 1361 - DNA, 253 bp, Unknown
  Description of Unknown: bacterium polynucleotide
  Clostridia; Clostridiaceae
tacgtaggtggcgagcgttgtccggatttactgggcgtaaaggatgcgtaggcggatttttaagtgagatgtgaaatacccgggcttaacttgggtgctgcatttcaaactggaagtctagagtgcgggagaggagagtggaattcctagtgtagcggtgaaatgcgtagagattaggaagaacaccagtggcgaaggcgactctctggaccgtaactgacgctgaggcatgaaagcgtgggtagcaaacagg

SEQ ID NO: 1362 - DNA, 253 bp, Unknown
  Description of Unknown: bacterium polynucleotide
  Clostridia; Clostridiaceae
tacgtaggtggcgagcgttgtccggatttactgggcgtaaagggagcgtaggcggacttttaagtgagatgtgaaatactcgggcttaacctgagtgctgcatttcaaactggaagtctagagtgcaggagaggagaagggaattcctagtgtagcggtgaaatgcgtagagattaggaagaacaccagtggcgaaggcgcttctctggactgtaactgacgctgaggctcgaaagcgtggggagcaaacagg

SEQ ID NO: 1363 - DNA, 253 bp, Unknown
  Description of Unknown: bacterium polynucleotide
  Clostridia; Clostridiaceae
tacgtaggtggcaagcgttgtccggatttactgggcgtaaagggtgcgtaggcggacctttaagtgagatgtgaaatccccgagcttaacttgggggctgcatttcaaactggaggtctagagtgcaggagaggagagtggaattcctagtgtagcggtgaaatgcgtagagattaggaagaacaccagtggcgaaggcgactctctggactgtaactgacgctgaggcacgaaagcgtggggagcaaacagg

SEQ ID NO: 1364 - DNA, 253 bp, Caloramator sp.
  Clostridia; Clostridiaceae; Caloramator
tacgtaggtggcaagcgttgtccggaattactgggcgtaaagggtgcgtaggcggtcctttaagtgggatgtgaaatccctgggcttaacccaggaactgcattccaaactggaggactagagtgcaggagaggaaagcggtattcccagtgtagcggtgaaatgcgtagagattgggaggaacaccagtagcgaaggcggctttctggaatgtaactgacgctgaggcacgaaagcgtggggagcaaacagg

SEQ ID NO: 1365 - DNA, 253 bp, Clostridium butyricum
  Clostridia; Clostridiaceae; Clostridium butyricum
tacgtaggtggcaagcgttgtccggatttactgggcgtaaagggagcgtaggtggatatttaagtgggatgtgaaatacctgagcttaacttgggtgctgcattccaaactggatatctagagtgcgggagaggaaagtggaattcctagtgtagcggtgaaatgcgtagagattaggaagaaccccagtggcgaaggcgactttctggactgtaactgacactgaggctcgaaagcgtggggagcaaacagg

SEQ ID NO: 1366 - DNA, 253 bp, Clostridium intestinale
  Clostridia; Clostridiaceae; Clostridium intestinale
tacgtaggtggcaagcgttgtccggatttactgggcgtaaagggagcgtaggcggatacttaagtgggatgtgaaatacctgggcttaacttgggtgctgcattccaaactgggtgtctagagtgttggagaggaaagtggaattcctagtgtagcggtgaaatgcgtagagattaggaagaacaccagtggcgaaggcgactttctggacaataactgacgctgaggctcgaaagcgtggggagcaaacagg

SEQ ID NO: 1367 - DNA, 253 bp, Clostridium butyricum
  Clostridia; Clostridiaceae; Clostridium butyricum
tacgtaggtggcaagcgttgtccggatttactgggcgtaaagggagcgtaggtggatatttaagtgggatgtgaaatactcgggcttaacttgagtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 1368 - DNA, 252 bp, Clostridium hiranonis
  Clostridia; Clostridiaceae; Clostridium hiranonis
tacgtagggggctagcgttatccggatttactgggcgtaaagggtgcgtaggcggtctttcaagtcaggagttaaaggctacggctcaaccgtagtaagctcctgatactgtctgacttgagtgcaggagaggaaagcggaattcccagtgtagcggtgaaatgcgtagatattgggaggaacaccagtagcgaaggcggctttctggactgtaactgacgctgaggcacgaaagcgtggggagcaaacagg

SEQ ID NO: 1369 - DNA, 253 bp, Clostridium butyricum
  Clostridia; Clostridiaceae; Clostridium butyricum
gacagaggatgcaagcgttatccggatttactgggcgtaaagggagcgtaggtggatatttaagtgggatgtggaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 1370 - DNA, 253 bp, Clostridium sp.
  Clostridia; Clostridiaceae; Clostridium
tacgtaggtggcaagcgttgtccggatttactgggcgtaaaggatgcgtaggcggatatttaagtgggatgtgaaatacccgggctcaacttgggtgctgcattccaaactggatatctagagtgtgggagaggaaaatggaattcctagtgtagcggtgaaatgcgtagagattaggaagaacaccagtggcgaaggcgattttctggaccataactgacgctgaggcatgaaagcgtggggagcaaacagg

SEQ ID NO: 1371 - DNA, 253 bp, Clostridium pasteurianum
  Clostridia; Clostridiaceae; Clostridium pasteurianum
tacgtaggtggcaagcgttgtccggatttactgggcgtaaaggatgtgtaggcggatacttaagtgagatgtgaaagccccgggcttaacctggggactgcatttcaaactgggtatctagagtgcaggagaggaaggcggaattcctagtgtagcggtgaaatgcgtagagattaggaagaacatcagtggcgaaggcggctttctggactgtaactgacgctgaggcatgaaagcgtggggagcaaacagg

SEQ ID NO: 1372 - DNA, 253 bp, Clostridium intestinale
  Clostridia; Clostridiaceae; Clostridium intestinale
tacgtaggtggcaagcgttgtccggatttactgggcgtaaagggagcgtaggcggatttttaagtgggatgtgaaatacccgggctcaacttgggtgctgcattccaaactggaagtctagagtgttggagaggaaagtgggattcctagtgtagcggtgaaatgcgtagatattaggaagaacaccagtggcgaaggcgactttctggacaataactgacgctgaggctcgaaagcgtggggagcaaacagg

SEQ ID NO: 1373 - DNA, 253 bp, Clostridium butyricum
  Clostridia; Clostridiaceae; Clostridium butyricum
gacggggggggcaagtgttgtccggatttactgggcgtaaagggagcgtaggtggatatttaagtgggatgtgaaatactcgggcttaacctgggtgctgcattccaaactgaatatctagagtgcaggagaggaaagtagaattcctagtgtagcggtgaaatgcgtagagattgggaagaataccagtggcgaaggcgactttctggactgtaactgacactgtggctcgaaagcgtggggagcaaacagg

SEQ ID NO: 1374 - DNA, 253 bp, Clostridium sp.
  Clostridia; Clostridiaceae; Clostridium
tacgtaggtggcaagcgttgtccggatttactgggcgtaaaggatgcgtaggcggatatttaagtcagatgtgaaattcccgggctcaacttgggagctgcatttgaaactggatatctagagtgcgggagaggagagtggaattcctagtgtagcggtgaaatgcgtagagattaggaagaacaccagtggcgaaggcgactctctggaccgtaactgacgctgaggcatgaaagcgtggggagcaaacagg

SEQ ID NO: 1375 - DNA, 253 bp, Clostridium sp.
  Clostridia; Clostridiaceae; Clostridium
tacgtaggtggcaagcgttgtccggaattactgggcgtaaaggatgcgtaggcggatgcttaagtcagatgtgaaaatcccgggcttaacttgggaactgcatttgaaactgggcatctagagtgcaggagaggagagtggaattcctagtgtagcggtgaaatgcgtagagattaggaagaacaccagtggcgaaggcggctctctggactgtaactgacgctgaggcatgaaagcgtggggagcaaacagg

SEQ ID NO: 1376 - DNA, 253 bp, Clostridium sp.
  Clostridia; Clostridiaceae; Clostridium
tacgtaggtggcgagcgttgtccggaattactgggcgtaaagggcgtgtaggcggggggacaagtcagatgtgaaataccgcagcttaactgcggggctgcatctgaaactgttcttcttgagtgtcggagaggaaagcggaattcccagtgtagcggtgaaatgcgtagagattgggaggaacaccggtggcgaaggcggctttctggacgacaactgacgctgaggcgcgaaagcgtggggagcaaacagg

SEQ ID NO: 1377 - DNA, 253 bp, Clostridium sp.
  Clostridia; Clostridiaceae; Clostridium
tacgtaggtggcaagcgctgtccggatttactgggcgtaaagggagcgtaggtggatgtttaagtgggatgtgaagtacctgggcttaacttgggtgctgcattccaaactggatatctagagtgcaggagaggaaagtggaattcctagtgtagcggtgaaatgcgcagagattagggagaacaccagtggcgaaggcgactttctggactgtaactgacactgaggctcgaaagcgtggggagcaaacagg

SEQ ID NO: 1378 - DNA, 253 bp, Clostridium sp.
  Clostridia; Clostridiaceae; Clostridium
tacgtaggtggcgagcgttgtccggatttactgggcgtaaaggatgcgtaggcggatatttaagtgagatgtgaaatacccgagcttaacttgggtgctgcatttcaaactggatatctagagtgtgggagaggagaatggaattcctagtgtagcggtgaaatgcgtagagattaggaagaacaccagtggcgaaggcgattctctggaccataactgacgctgaggcatgaaagcgtgggtagcaaacagg

SEQ ID NO: 1379 - DNA, 253 bp, Clostridium sp.
  Clostridia; Clostridiaceae; Clostridium
tacgtaggtggcaagcgttgtccggaattactgggcgtaaaggatgtgtaggcggatatttaagtgagatgtgaaatccccgagctcaacttgggggctacatttcaaactgggtatctagagtgcaggagaggaaagcggaattcctagtgtagcggtgaaatgcgtagagattaggaagaacatcagtggcgaaggcggctttctggactgtaactgacgctgaggcatgaaagcgtggggagcaaacagg

SEQ ID NO: 1380 - DNA, 253 bp, Clostridium bowmanii
  Clostridia; Clostridiaceae; Clostridium bowmanii
tacgtaggtggcaagcgttgtccggatttactgggcgtaaaggatgcgtaggcggacatttaagtcagatgtgaaatacccgagcttaacttgggtgctgcatttgaaactgggtgtctagagtgcaggagaggtaagtggaattcctagtgtagcggtgaaatgcgtagagattaggaagaacaccagtggcgaaggcgacttactggactgtaactgacgctgaggcatgaaagcgtggggagcaaacagg

SEQ ID NO: 1381 - DNA, 253 bp, Clostridium sp.
  Clostridia; Clostridiaceae; Clostridium
tacgtaggtggcaagcgttgtccggatttactgggtgtaaagggcgcgtaggcgggtatataagtcagtcgtgaaataccgaggctcaacttcggggctgcgattgaaactgtatatcttgagtatcggagaggaaagcggaattcctagtgtagcggtgaaatgcgtagatattagggggaacaccagcggcgaaggcggctttctggacgacaactgacgctgaggcgcgaaagtgtggggagcaaacagg

SEQ ID NO: 1382 - DNA, 252 bp, Unknown
  Description of Unknown: bacterium polynucleotide
  Clostridia; Clostridiaceae; SMB53
cacgtagggcgcgagcgttaatcggaattactgggcgtaaagggtgcgtaggtggtttcttaagtcagaggtgaaaggctacggctcaaccgtagtaagcctttgaaactgggaaacttgagtgcaggagaggagagtggaattcctagtgtagcggtgaaatgcgtagatattaggaggaacaccagttgcgaaggcggctctctggactgtaactgacactgaggcacgaaagcgtggggagcaaacagg

SEQ ID NO: 1383 - DNA, 253 bp, Thermoanaerobacterium saccharolyticum
  Clostridia; Clostridiaceae; Thermoanaerobacterium saccharolyticum
tacgtagggggcgagcgttgtccggaattactgggcgtaaagagcacgtaggcggctatataagtcaggtgtgaaaaacctgggcttaaccgagggtatgcatctgaaactatatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacagg

SEQ ID NO: 1384 - DNA, 253 bp, Thermoanaerobacterium sp.
  Clostridia; Clostridiaceae; Thermoanaerobacterium
tacgtagggggcaagcgttgtccggagtgactgggcgtaaagggcgcgtaggcggttatacaagtcaggtgtaaaagataccggctcaaccggtagatagcatctgatactgtataactagagtacaggagaggggagcggaattcctggtgtagcggtgaaatgcgtagagatcaggaagaacaccggtggcgaaggcggctctctggcctgggactgacgctgaggcgcgaaagcgtggggagcgaacagg

SEQ ID NO: 1385 - DNA, 253 bp, Unknown
  Description of Unknown: bacterium polynucleotide
  Clostridia; Lachnospiraceae
tacgtagggggcaagcgttatccggatttactgggtgtaaagggagcgtagacggctctgcaagtctggagtgaaagcccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 1386 - DNA, 253 bp, Unknown
  Description of Unknown: bacterium polynucleotide
  Clostridia; Lachnospiraceae
tacgtagggggcaagcgttatccggatttactgggtgtaaagggagcgtagacggtgaagcaagtctgaagtgaaaggccggggctcaaccccgggactgctttggaaactgtttgactggagtacaggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 1387 - DNA, 253 bp, Unknown
  Description of Unknown: bacterium polynucleotide
  Clostridia; Lachnospiraceae
tgcgtagggggcaagcgttatccggatttactgggtgtaaagggagcgtagacggactggcaagtctgatgtgaaaacccggggctcaaccccgggactgcattggaaactgtcagtctagagtgtcggaggggtaagtggaattcctagtgtagcggtgaaatgcgtagatattaggaggaacaccagtggcgaaggcggcttactggacgataactgacgttgaggctcgaaagcgtggggagcaaacagg

SEQ ID NO: 1388 - DNA, 253 bp, Ruminococcus sp.
  Clostridia; Lachnospiraceae; Ruminococcus
tacgtatggtgcaagcgttatccggatttactgggtgtaaagggagcgtagacggacttgcaagtctgaagtgaaagcccggggctcaaccccgggactgctttggaaactgtaggtctagagtgctggagaggtaagtggaattcctagtgtagcggtgaaatgcgtagatattaggaggaacaccagcggcgaaggcggcttactggacagtaactgacgttgaggctcgaaagagtggggagcaaacagg

SEQ ID NO: 1389 - DNA, 253 bp, Anaerostipes sp.
  Clostridia; Lachnospiraceae; Anaerostipes
tacgtatggggcaagcgttatccggatttactgggtgtaaagggagcgtaggcggtgcggcaagtcagaagtgaaagcctggggctcaaccccggaattgcttttgaaactgtcgaactagagtgtcggaggggtaagcggaattcctagtgtagcggtgaaatgcgtagatattaggaggaacaccggtggcgaaggcggcttactggacgattactgacgctgaggctcgaaagcgtggggagcaaacagg

SEQ ID NO: 1390 - DNA, 253 bp, Anaerostipes sp.
  Clostridia; Lachnospiraceae; Anaerostipes
tacgtagggggcaagcgttatccggatttactgggtgtaaagggagcgtagacggtatggtaagtcagatgtgaaagcccggggctcaaccccgggactgcatttgaaactatcagactagagtgcaggagaggtaagtggaattcctagtgtagcggtgaaatgcgtagatattaggaggaacaccagtggcgaaggcgacttactggactgtaactgacgttgaggctcgaaagcgtggggagcaaacagg

SEQ ID NO: 1391 - DNA, 253 bp, Blautia sp.
  Clostridia; Lachnospiraceae; Blautia
tacgtagggggcgagcgttatccggatttactgggtgtaaagggagcgtagacggcgtatcaagtctgatgtgaaaggcaggggcttaacccctggactgcattggaaactggtatgcttgagtgccggaggggtaagcggaattcctagtgtagcggtgaaatgcgtagatattaggaggaacaccagtggcgaaggcggcctactggacggtaactgacgttgaggctcgaaagcgtggggagcaaacagg

SEQ ID NO: 1392 - DNA, 253 bp, Blautia sp.
  Clostridia; Lachnospiraceae; Blautia
tacgtagggggcaagcgttatccggatttactgggtgtaaagggagcgtagacggagcagcaagtctgatgtgaaaggcgggggctcaacccccggactgcattggaaactgttggtcttgagtaccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 1393 - DNA, 253 bp, Blautia sp.
  Clostridia; Lachnospiraceae; Blautia
tacgtaggtggcaagcgttatccggaattattgggcgtaaagcgcgcgtaggcggttttttaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 1394 - DNA, 253 bp, Coprococcus sp.
  Clostridia; Lachnospiraceae; Coprococcus
tacgtatggagcaagcgttatccggatttactgggtgtaaagggtgcgtaggtggcagtgcaagtcagatgtgaaaggccggggctcaaccccggagctgcatttgaaactgcatagctggagtacaggagaggcaggcggaattcctagtgtagcggtgaaatgcgtagatattaggaggaacaccagtggcgaaggcggcctgctggactgttactgacactgaggcacgaaagcgtggggagcaaacagg

SEQ ID NO: 1395 - DNA, 253 bp, Coprococcus sp.
  Clostridia; Lachnospiraceae; Coprococcus
tacgtagggggcaagcgttatccggatttactgggtgtaaagggagtgtaggtggtctggcaagtcagatgtgaaagcccgcggctcaactgcgggactgcatttgaaactgtcagactggagtgcaggagaggaaagtggaattcctagtgtagcggtgaaatgcgtagatattaggaagaacaccagtggcgaaggcggctttctggactgtaactgacactgaggctcgaaagcgtggggagcaagcagg

SEQ ID NO: 1396 - DNA, 253 bp, Coprococcus sp.
  Clostridia; Lachnospiraceae; Coprococcus
tacgtagggggcaagcgttatccggatttactgggtgtaaagggagcgtaggtggtttggtaagtcaggtgtgaaagcccggggctcaactccgggattgcacttgaaactatcaaactagagtgcaggagaggtaagtggaattcctagtgtagcggtgaaatgcgtagatattaggaggaacaccagtggcgaaggcggcttactggactgtaactgacactgaggctcgaaagcgtggggagcaaacagg

SEQ ID NO: 1397 - DNA, 253 bp, Thermincola ferriacetica
  Clostridia; Peptococcaceae; Thermincola ferriacetica
tacgtaggtggcaagcgttgtccggaattactgggcgtaaagagcgcgtaggcgggcgcttaagtcaggggtgaaaactggcagctcaactgccagcctgcctttgagactgggcgtcttgaggacaggagaggagagcggaattcctagtgtagcggtgaaatgcgtagatattaggaggaacaccagtggcgaaggcggctctctggcctgtaactgacgctgaggcgcgaaagcgtggggagcgaacggg

SEQ ID NO: 1398 - DNA, 252 bp, Unknown
  Description of Unknown: bacterium polynucleotide
  Clostridia; Peptostreptococcaceae
tacgtagggggctagcgttatccggaattactgggcgtaaagggtgcgtaggtggtttcttaagtcagaagtgaaaggctacggctcaaccgtagtaagcttttgaaactgagaaacttgagtgcaggagaggagagtagaattcctagtgtagcggtgaaatgcgtagatattaggaggaataccagttgcgaaggcggctctctggactgtaactgacactgaggcacgaaagcgtggggagcaaacagg

SEQ ID NO: 1399 - DNA, 252 bp, Filifactor sp.
  Clostridia; Peptostreptococcaceae; Filifactor
tacgtagggggcaagcgttatccggaataactgggcgtaaagggtgcgcaggtggtttaacaagttagtggtgaaaggcataggctcaaccaatgtaagccattaaaactgtttaacttgagtgcaggagaggaaagtggaattcctagtgtagcggtgaaatgcgtagatattaggaggaataccagtggcgaaggcgactttctggactgcaactgacactgaggcacgaaagcgtggggagcaaacagg

SEQ ID NO: 1400 - DNA, 253 bp, Unknown
  Description of Unknown: bacterium polynucleotide
  Clostridia; Ruminococcaceae
tacgtaggtggcgagcgttatccggaattactgggtgtaaagggtgtgtaggcggggaggcaagtcagatgtgaaaaccaaaagctcaacttttggcctgcatttgaaactgtttctcttgagagtgggagaggtaaatggaattcctggtgtagtagtgaaatgcgtagatatcaggaggaacaccggtggcgaaggcgatttactggaccattgctgacgctgagacacgaaagcgtggggagcaaacagg

SEQ ID NO: 1401 - DNA, 253 bp, Unknown
  Description of Unknown: bacterium polynucleotide
  Clostridia; Ruminococcaceae
tacgtagggagcaagcgttgtccggaattactgggtgtaaagggagcgtaggcgggaatgtaagttggatgtgaaacctccgggcttaacctggagactgcattcaaaactgcatttcttgagtgaagtagaggcaagcggaattcctagtgtagcggtgaaatgcgtagatattaggaggaacaccagtggcgaaggcggcttgctgggcttttactgacgctgaggctcgaaagtgtggggagcaaacagg

SEQ ID NO: 1402 - DNA, 253 bp, Unknown
  Description of Unknown: bacterium polynucleotide
  Clostridia; Ruminococcaceae
tacgtaggtggcaagcgttgtccggaattactgggtgtaaagggagcgcaggcgggactgcaagttggatgtgaaatgtcgcggcttaaccgcggagctgcatccaaaactgtagttcttgagtggagtagaggtaggcggaattccgagtgtagcggtgaaatgcgtagatattcggaggaacaccagtggcgaaggcggcctactgggctcttactgacgctgaggctcgaaagtgtggggagcaaacagg

SEQ ID NO: 1403 - DNA, 253 bp, Unknown
  Description of Unknown: bacterium polynucleotide
  Clostridia; Ruminococcaceae
tacgtaggtggcaagcgttgtccggatttactgggtgtaaagggcgtgtaggcggagctgcaagtcagatgtgaaatctctgggctcaacccagaaactgcatttgaaactgtagcccttgagtatcggagaggcaagcggaattcctagtgtagcggtgaaatgcgtagatattaggaggaacaccagtggcgaaggcggcttgctggacgacaactgacgctgaggcgcgaaagcgtggggagcaaacagg

SEQ ID NO: 1404 - DNA, 252 bp, Unknown
  Description of Unknown: bacterium polynucleotide
  Clostridia; Ruminococcaceae
tacgtaggtggcaagcgttgtccggatttactgggtgtaaaggcgcgtaggcgggtaggcaagtcagatgtgaaatctccgggctcaacccggaaactgcatttgaaactgtctatcttgagtatcggagaggcaagcggaattccgtgtgtagcggtgaaatgcgtagatatacggaggaacaccagtggcgaaggcggcttgctggacgacaactgacgctgaggcgcgaaagcgtggggagcaaacagg

SEQ ID NO: 1405 - DNA, 253 bp, Clostridium hungatei
  Clostridia; Ruminococcaceae; Clostridium hungatei
tacgtaggtggcaagcgttgtccggaattactgggtgtaaagggcgtgtaggcgggaatgtaagtcagatgtgaaatcccaaagcttaactttggagctgcatctgaaactatgtttcttgagtgtcggagaggaaagcggaattcctagtgtagcggtgaaatgcgtagatattaggaggaacaccagtggcgaaggcggctttctggacgataactgacgctgaggcgcgaaagcgtggggagcaaacagg

SEQ ID NO: 1406 - DNA, 253 bp, Ethanoligenens sp.
  Clostridia; Ruminococcaceae; Ethanoligenens
tacgtaggtggcaagcgttgtccggaattactgggtgtaaagggtgcgcaggcggggcggcaagttggatgtgaaatacccgggctcaactcgggggctgcattcaaaactgtcgttcttgagtgaagtagaggtaggcggaattcccggtgtagcggtgaaatgcgtagatatcgggaggaacaccagtggcgaaggcggcctactgggcttttactgacgctgaggcacgaaagcatgggtagcaaacagg

SEQ ID NO: 1407 - DNA, 253 bp, Faecalibacterium prausnitzii
  Clostridia; Ruminococcaceae; Faecalibacterium prausnitzii
aacgtaggtcacaagcgttgtccggaattactgggtgtaaagggagcgcaggcgggagaacaagttggaagtgaaatccatgggctcaacccatgaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacagg

SEQ ID NO: 1408 - DNA, 253 bp, Faecalibacterium prausnitzii
  Clostridia; Ruminococcaceae; Faecalibacterium prausnitzii
aacgtagggtgcaagcgttgtccggaattactgggtgtaaagggagcgcaggcggaccggcaagttggaagtgaaaactacgggctcaacccataaattgctttcaaaactgctggccttgagtagtgcagaggtaagtggaattcccggtgtagcggtggaatgcgtagatatcgggaggaacaccagtggcgaaggcgacctactgggcaccaactgacgctgaggctcgaaagcatgggtagcaaacagg

SEQ ID NO: 1409 - DNA, 253 bp, Faecalibacterium prausnitzii
  Clostridia; Ruminococcaceae; Faecalibacterium prausnitzii
aacgtaggtcacaagcgttgtccggaattactgggtgtaaagggagcgcaggcgggtatgcaagttgggagtgaaatacatgggctcaacccatgaactgctctcaaaactgtgtatcttgagtagtgcagaggtaggcggaattcccggtgtagcggtggaatgcgtagatatcgggaggaacaccagtggcgaaggcggcctactgggcaccaactgacgctgaggctcgaaagtgtggggagcaaacagg

SEQ ID NO: 1410 - DNA, 253 bp, Faecalibacterium prausnitzii
  Clostridia; Ruminococcaceae; Faecalibacterium prausnitzii
aacgtagggtgcaagcgttgtccggaattactgggtgtaaagggagcgcaggcgggaagacaagttggaagtgaaaaccatgggctcaacccatgaattgctttcaaaactgtttttcttgagtagtgcagaggtagatggaattcccggtgtagcggtggaatgcgtagatatcgggaggaacaccagtggcgaaggcggcctactgggcaccaactgacgctgaggctcgaaagtgtgggtagcaaacagg

SEQ ID NO: 1411 - DNA, 253 bp, Oscillospira sp.
  Clostridia; Ruminococcaceae; Oscillospira
tacgtaggtggcaagcgttgtccggatttactgggtgtaaagggcgtgcagccgggccggcaagtcagatgtgaaatctggaggcttaacctccaaactgcatttgaaactgtaggtcttgagtaccggagaggttatcggaattccttgtgtagcggtgaaatgcgtagatataaggaagaacaccagtggcgaaggcggataactggacggcaactgacggtgaggcgcgaaagcgtggggagcaaacagg

SEQ ID NO: 1412 - DNA, 253 bp, Ruminococcus bromii
  Clostridia; Ruminococcaceae; Ruminococcus bromii
aacgtagggtgcaagcgttgtccggaattactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacagg

SEQ ID NO: 1413 - DNA, 253 bp, Ruminococcus sp.
  Clostridia; Ruminococcaceae; Ruminococcus
tacgtaggtggcaagcgttgtccggaattactgggtgtaaagggagtgtaggcgggatattaagtcagaagtgaaaattacgggctcaactcgtaacctgcttttgaaactgacattcttgagtgaagtagaggcaagcggaattcctagtgtagcggtgaaatgcgtaggtattaggaggaacaccggtggcgaaggcggcttgctgggcttttactgacgctgaggctcgaaagcgtggggagcaaacagg

SEQ ID NO: 1414 - DNA, 253 bp, Carboxydothermus ferrireducens
  Clostridia; Thermoanaerobacteraceae; Carboxydothermus ferrireducens
aacgtagggggcgagcgttgtccggaattactgggcgtaaagagctcgtaggcggtctggtaagtcaggtgtaaaaggccacggctcaaccgtgggggagcacctgatactgctggacttgagggcaggagaggagagtggaattcccggtgtagcggtgaaatgcgtagatatcgggaggaacaccagtggcgaaggcggctctctggactgaacctgacgctgaggagcgaaagccaggggagcgaaccgg

SEQ ID NO: 1415 - DNA, 252 bp, Dialister sp.
  Clostridia; Veillonellaceae; Dialister
tacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacagg

SEQ ID NO: 1416 - DNA, 252 bp, Megasphaera sp.
  Clostridia; Veillonellaceae; Megasphaera
tacgtaggtggcaagcgttgtccggaattattgggcgtaaagggcgtgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacagg

SEQ ID NO: 1417 - DNA, 252 bp, Veillonella dispar
  Clostridia; Veillonellaceae; Veillonella dispar
cacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 1418 - DNA, 252 bp, Unknown
  Description of Unknown: bacterium polynucleotide
  Coriobacteriia; Coriobacteriaceae
tacgtagggggcaagcgttatccggattcattgggcgtaaagcgcgcgtaggcggccagcctggtcgggagtcaaatccgggggctcaacccccgtccgctcccgataccggccggcttgagtctggcaggggaaggcggaattcccggtgtagcggtggaatgcgcagatatcgggaagaacaccggtggcgaaggcggccttctgggccacgactgacgctgaggcgcgaaagctaggggagcgaacagg

SEQ ID NO: 1419 - DNA, 252 bp, Atopobium sp.
  Coriobacteriia; Coriobacteriaceae; Atopobium
tacgtagggggcaagcgttatccggattcattgggcgtaaagcgctcgtaggcggtctgttaggtcgggagttaaatccgggggctcaacccccgttcgctcccgataccggcagacttgagtttggtaggggaaggtggaattcctagtgtagcggtggaatgcgcagatattaggaagaacaccagtggcgaaggcggccttctgggccataactgacgctgaggagcgaaagctaggggagcaaacagg

SEQ ID NO: 1420 - DNA, 253 bp, Unknown
  Description of Unknown: bacterium polynucleotide
  Cytophagia
tacggagggtgcaagcgttgtccggatttattgggtttaaagggtgcgtaggcggtcttttaagtcagcggtgaaattactgagctcaactcggtgactgccgttgatactgattgacttgagtattgacgaagagggcggaattgaaggtgtagcggtgaaatgcatagatatcttcaagaacaccgattgcgaaggcagctctctagggaataactgacgctgaggcacgaaagcgtgggtagcaaacagg

SEQ ID NO: 1421 - DNA, 253 bp, Unknown
  Description of Unknown: bacterium polynucleotide
  Cytophagia
tacggagggtgcaagcgttgtccggatttattgggtttaaagggtgcgtaggtggcttattaagtcagtgtttaaagtcaatagctcaactattggaatggcattgatactgatgagcttgagtaaagttgaggtagacagaattgatggtgtagcggtgaaatgcatagatatcatcaagaataccgattgcgaaggcagtttactaagctttaactgacactgaggcacgaaagtgtggggatcaaacagg

SEQ ID NO: 1422 - DNA, 253 bp, Candidatus amoebophilus
  Cytophagia; Amoebophilaceae; Candidatus Amoebophilus
tacgtagggtgcaagcgttatccggatttactgggtttaaagggtgcgtaggcggctttttaagtcagtggtgaaatcctagtgctcaacactagaactgccattgaaactgaagggctcgagtcaaggagaggtaagcagaatttatagtgtagtagtgaaatgcttagatactataaggaataccgatagcgaaggcagcttactggccttgcactgacgctgaggcacgaaagcgtggggagcaaacagg

SEQ ID NO: 1423 - DNA, 253 bp, Algoriphagus sp.
  Cytophagia; Cyclobacteriaceae; Algoriphagus
tacggagggtgcaggcgttgtccggatttattgggtttaaagggtgcgtaggcggccatttaagtcagcggtgaaagaccccggctcaaccggggcagtgccattgatactggatggcttgagtgttggaggggtacatggaattgatggtgtagcggtgaaattcatagataccatcaggaacaccgatagcgaaggcattgtactggccaacaactgacgctgaggcacgaaagcatgggtagcgaacagg

SEQ ID NO: 1424 - DNA, 253 bp, Algoriphagus terrigena
  Cytophagia; Cyclobacteriaceae; Algoriphagus terrigena
tacggagggtgcaagcgttgtccggatttattgggtttaaagggtgcgtaggcggctatttaagtcagcggtgaaagacatcggctcaaccgatgcagtgccattgatactggatagcttgagtgttggaggggtacatggaattgatggtgtagcggtgaaatgcatagataccatcaggaacaccgatagcgaaggcattgtactggccaacaactgacgctgaggcacgaaagcatgggtagcgaacagg

SEQ ID NO: 1425 - DNA, 253 bp, Unknown
  Description of Unknown: bacterium polynucleotide
  Cytophagia; Cytophagaceae
tacgtaggtggcgagcgttgtccggatttattgggtttaaagggtgcgtaggcggttttgtaagtcagcgctgaaatatcccggcttaaccgggagggtggcattgatactgcaggacttgagtaaagttgtggtgggcggaattgacggtgtagcggtgaaatgcttagatatcgtcaagaacaccgatagtgaagacagctcactaagcttctattgacgctgaggcacgaaagtgtggggatcaaacagg

SEQ ID NO: 1426 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtcctataagtcagtgctgagatatcccggcttaaccgggagggtggcattgatactgcaggacttgagtaaagttgaggttggcggaattgacggtgtagcggtgaaatgcttagatatcgtcaagaacaccgattgcgaaggcagctaactaagttttaactgacgctgaggcacgaaagtgtggggatcaaacagg

SEQ ID NO: 1427 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtcttataagtcagtgctgaaatatcccggcttaaccgggagggtggcattgatactgtaggacttgagtaaagttgaggtaggcggaattgacggtgtagcggtgaaatgcttagatatcgtcaagaacaccgatagtgaagacagcttactaaactttaactgacgctgaggcacgaaagtgtggggatcaaacagg

SEQ ID NO: 1428 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggcctattaagtcagtggtgaaatatttcagctcaactggaattgtgccattgatactgatgggcttgagtacagatgaggtaggcggaattgacggtgtagcggtgaaatgcttagatatcgtcaagaacacctatagcgaaggcagcttactaggctgtaactgacgctgaggcacgaaagtgtggggatcaaacagg

SEQ ID NO: 1429 - DNA, 253 bp, Unknown
  Description of Unknown: bacterium polynucleotide
  Cytophagia; Cytophagaceae
tacgtaggtggcaagcgttgtccggatttatcgggtttaaagggtgcgtaggcggttccataagtcagtggtgaaatacaatagcttaactattgaggtgccattgatactgcggaacttgagtacagacgaggtaggcggaattgacggtgtagcggtgaaatgcttagatatcgtcaagaacaccgatagcgaaggcagcttactagactgtaactgacgctgaggcacgaaagtgtggggatcaaacagg

SEQ ID NO: 1430 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggctttgtaagtcagtggtgaaatacggcagctcaactgtcgaggtgccattgatactgcagagctagagtactgatgaggtaggcggaatggacggtgtagcggtgaaatgcttagatatcgtccagaacaccgatagcgaaggcagcttactaaagagtaactgacgctgaggcacgaaagtgtggggatcaaacagg

SEQ ID NO: 1431 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtctattaagtcagtggtgaaatatcgcagcttaactgtgagggtgccattgatactgatggacttgagtgaagtcgaagtaggcggaattgacggtgtagcggtgaaatgcttagatatcgtcaagaacaccgatagtgaagacagcttactaggcttatactgacgctgaggcacgaaagtgtggggatcaaacagg

SEQ ID NO: 1432 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggccctataagtcagtgctgaaatatcccggctcaaccgggagggtggcattgatactgtagggcttgagtaaagttgaggttggcggaattgacggtgtagcggtgaaatgcttagatatcgtcaagaacacctattgcgaaggcagctaactaagctttaactgacgctgaggcacaaaagtgtggggatcaaacagg

SEQ ID NO: 1433 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggtggttccataagtcagtggtgaaatacggcagcttaactgtcgaggtgccattgatactgcggaacttgagtacagacgaggtaggcggaattgacggtgtagcggtgaaatgcttagatatcgtcaagaacaccgatagcgaaggcagcttactagactgtaactgacactgaggcacgaaagtgtggggatcaaacagg

SEQ ID NO: 1434 - DNA, 253 bp, Unknown
  Description of Unknown: bacterium polynucleotide
  Cytophagia; Cytophagaceae
tacggagggtgcaagcgttgtccggatttattgggtttaaagggtgcgtaggtggctgtttaagtcagtggtgaaagcctgcagcttaactgtaggactgccattgatactgaatagcttgagtactgatgaggtaggcggaattgatagtgtagcggtgaaatgcatagatattatcaagaacaccgattgcgaaggcagcttactaaggagttactgacactgaggcacgaaagcgtggggatcaaacagg

SEQ ID NO: 1435 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggttccataagtcagtggtgaaatacggcagctcaactgtcgaggtgccattgatactgcggaacttgagtactgatgaggtaggcggaattgacggtgtagcggtgaaatgcttagatatcgtcaagaacaccgatagcgaaggcagcttaccaagcagtaactgacgctgaggcacgaaagtgcggggatcaaacagg

SEQ ID NO: 1436 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtccattaagtcagtggtgaaatacggcagcttaactgtcgaggtgccattgatactggaggacttgagtacagacgaggtaggcggaattgacggtgtagcggtgaaatgcttagatatcgtcaagaacaccgatagcgaaggcagcttactagactgtaactgacgctgaggcacgaaagtgtggggatcaaacagg

SEQ ID NO: 1437 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggttctataagtcagtggtgaaatacggcagctcaactgtcgaggtgccattgatactgtaggactagagtactgttgaggtaggcggaatggacggtgtggcggtgaaatgcttagatatcgtccagaacaccgatagcgaaggcagcttactaaggagtaactgacgctgaggcacgaaagtgtggggatcaaacagg

SEQ ID NO: 1438 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggtggtcaattaagtcagtgctgaaatatcccggcttaaccgggagggtggcattgatactgattggcttgagtggagttgaggtaggcggaattgacggtgtagcggtgaaatgcttagatatcgtcaagaacaccgatagcgaaggcagcttaccaagctttaactgacactgatgcacgaaagtgtggggatcaaacagg

SEQ ID NO: 1439 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggtggccctgtaagtcagtggtgaaatatctcagcttaactgagagggtgccattgatactgcagggcttgagtacagatgaggtaggcggaattgacggtgtagcggtgaaatgcatagatatcgtcaagaacaccgatagcgaaggcagcttaccaagctgtaactgacactgaggcacgaaagtgtggggatcaaacagg

SEQ ID NO: 1440 - DNA, 253 bp, Unknown
  Description of Unknown: bacterium polynucleotide
  Cytophagia; Cytophagaceae
tacgtaggtggcgagcgttgtccggatttattgggtttaaagggtgcgtaggcggttttgtaagtcagtgctgaaatatcccggcttaaccgggagggtggcattgatactgcaggacttgagtaaagttgaggtgggcggaattgacggtgtagcggtgaaatgcttagatatcgtcaagaacaccgattgcgaaggcagctcactaagctttaactgacgctgaggcacgaaagtgtggggatcaaacagg

SEQ ID NO: 1441 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggttttgtaagtcagtggtgagatatgtcagcttaactgagagggtgccattgatactgcagaacttgagtacagatgaggtaggcggaattgacggtgtagcggtgaaatgcttagatatcgtcaagaacacctatagcgaaggcagcttactaggctgtaactgacgctgaggcacgaaagtgtggggatcaaatagg

SEQ ID NO: 1442 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggccctgtaagtcagtgctgaaatcccccggcttaaccggggtggtggcattgatactgcagggcttgagtacagatgtggtaggcggaattgacggtgtagcggtgaaatgcatagatatcgtcaagaacaccgatagcgaaggcagcttactgggctgtaactgacgctgatgcacgaaagtgtggggatcaaacagg

SEQ ID NO: 1443 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggccttgtaagtcagtggtgaaatactccagcttaactggaggggtgccaatgatactgcagggcttgagtacagatgaggtaggcggaatcgacggtgtagcggtgaaatgcatagatatcgtcaagaacacctatagcgaaggcagcttactgggctgtagctgacgctgaggcacgaaagtgtggggatcaaacagg

SEQ ID NO: 1444 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtcttttaagtcagtgctgaaatactccagcttaactggaggggtggcattgatactggaagacttgagtgtagtcgaagtaggcggaattgacggtgtagcggtgaaatgcttagatatcgtcaagaacaccgatagtgaagacagcttactaggctacaactgacgctgaggcacgaaagtgtggggatcaaacagg

SEQ ID NO: 1445 - DNA, 253 bp, Unknown
  Description of Unknown: bacterium polynucleotide
  Cytophagia; Cytophagaceae
tacgtaggtggcaagcgttgtccggatttattgggcttaaagggtgcgtaggcggttatataagtcagtgctgaaatatcccggcttaaccgggagggtggcattgatactgtatgacttgagtaaagttgaggttggcggaattgacggtgtagcggtgaaacgcttagatatcgtcaagaacaccgattgcgaaggcagctaactaagctttaactgacgctgaggcacgaaagtgtggggatcaaacagg

SEQ ID NO: 1446 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggttgattaagtcagttgtgaaatacgatagctcaactatcgaggtgcaattgatactggttgacttgagtacagacgaggtaggcggaattgacggtgtagcggtgaaatgcatagatatcgtcaagaacaccgatagcgaaggcagcttactagactgtaactgacgctgaggcacgaaagtgtggggatcaaacggg

SEQ ID NO: 1447 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtctattaagtcagtgctgaaatatcccggcttaaccgggagggtggcattgatactgatggacttgagtgcagtcgaggtaggcggaattgacggtgtagcggtgaaatgcttagatatcgtcaagaacaccgatagtgtagacagcttactaggctgtaactgacgctgaggcacgaaagtgtggggatcaaacagg

SEQ ID NO: 1448 - DNA, 253 bp, Unknown
  Description of Unknown: bacterium polynucleotide
  Cytophagia; Cytophagaceae
tacgtaggtggcgagcgttgtccggatttattgggtttaaagggtgcgtaggcggctatttaagtcagcggtgaaatatctcagcttaactgagagggtgccattgatactggatagcttgagtacagatgaggtaggcggaattgacggtgtagcggtgaaatgcatagatatcgtcaagaacaccgatagcgaaggcagcttaccaagctgtaactgacgctgaggcacgaaagtgtggggatcaaacagg

SEQ ID NO: 1449 - DNA, 253 bp, Unknown
  Description of Unknown: bacterium polynucleotide
  Cytophagia; Cytophagaceae
tacgtaggtggcaagcgttgtccggatttattgggtttgaagggtgcgtaggcggccctgtaagtcagtgctgatatatcccagcttaactgggagggtggcattgatactgcggggctagagtacagatgaggtaggcggaattgacggtgtagcggtgaaatgcttagatatcgtcaagaacacctatagcgaaggcagcttactaggcagtaactgacgctgaggcacgaaagtgtggggatcaaacagg

SEQ ID NO: 1450 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggccccataagtcagtgctgaaatactctagcttaactagaggggtggcattgatactgcggggcttgagtgtagtcgaggtaggcggaattgacggtgtagcggtgaaatgcttagatatcgtcaagaacaccgatagtgtagacagcttactaggctacaactgacgctgaggcacgaaagtgtggggatcaaacagg

SEQ ID NO: 1451 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggttctataagtcagtggtgaaatccggcagctcaactgtcgatgtgccattgatactgcagaacttgagtacagacgaggtaggcggaattgacggtgtagcggtgaaatgcttagatatcgtcaagaacaccgatagcgaaggcagcttactagactgtaactgacgctgatgcacgaaagtgtggggatcaaacagg

SEQ ID NO: 1452 - DNA, 253 bp, Unknown
  Description of Unknown: bacterium polynucleotide
  Cytophagia; Cytophagaceae
tacgtagggtgcgagcgttaatcggaattactgggcgtaaagcgtgcgcaggcggttatataagacagttgtgaaatatggcagctcaactgtcaaggggccattgatactgatggacttgagtgaagtcgaagtaggcggaattgacggagtagcggtgaaatgcttagatatcgtcaagaacaccgatagtgaagacagcttactaggcttatactgacgctgaggcacgaaagtgtggggatcaaacagg

SEQ ID NO: 1453 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggttttgtaagtcagtggtgaaatactctagcttaactagaggggtgccaatgatactgcaagacttgagtacagatgaggtaggcggaattgacggtgtagcggtgaaatgcatagatatcgtcaagaacacctatagcgaaggcagcttactgggctgtaactgacgctgaggcacgaaagtgtggggatcaaacagg

SEQ ID NO: 1454 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggcctcctaagtcagttgtgaaataccccggctcaaccgggggggtgcgattgatactgggcggctcgagtaacagcgaggttggcggaattgacggtgtagcggtgaaatgcatagatatcgtcaagaacaccgatagcgaaggcagccaactaggggttaactgacgctgaggcacgaaagtgcggggatcaaacagg

SEQ ID NO: 1455 - DNA, 253 bp, Unknown
  Description of Unknown: bacterium polynucleotide
  Cytophagia; Cytophagaceae
tacagagggtgcaagcgttgtccggatttattgggtttaaagggtgcgtaggcggctttttaagtcagcggtgaaatacttcggctcaaccgaggaactgccgttgatactggaaggcttgagtactgatgaagtgggcggaattgaaggtgtagcggtgaaatgcatagatatcttcaagaacaccgattgcgaaggcagctcactaaggagtaactgacgctgaggcacgaaagcgtgggtagcaaacagg

SEQ ID NO: 1456 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtcaaataagtcagttgtgaaatacggcagctcaactgtcgaggtgcaattgatactgtttgacttgagtattgttgaggtaggcggaatggacggtgtagcggtgaaatgcttagagatcgtccagaacaccgatagcgaaggcagcttactaaagaataactgacgctgaggcacgaaagtgtggggatcaaacagg

SEQ ID NO: 1457 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggtggtcttgtaagtcagtggtgagatacggcagcttaactgtcgaggtgccattgatactgcgggacttgagtacagacgaggtaggcggaattgacggtgtagcggtgaaatgcttagatatcgtcaagaacaccgatagcgaaggcagcttactagactgtaactgatactgaggcacgaaggtgtggggatcaaacagg

SEQ ID NO: 1458 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggccctgtaagtcagtgctgaaatatcccggcttaaccgggagggtggcattgatactgcggggcttgagtacagatgaagtcggcggaattgacggtgtagcggtgaaatgcatagatatcgtcaagaacaccgatagcgaaggcagctgactaagttgtaactgacgctgaggcacgaaagtgtggggatcaaacagg

SEQ ID NO: 1459 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtcttctaagtcagttgtgaaatacttcagcttaactggagaggtgcaattgatactggaagacttgagtactgatgaggtaggcggaatggacggtgtagcggtgaaatgcttagatatcgtccagaacaccgatagcgaaggcagcttactaaggagtaactgacgctgaggcacgaaagtgtggggatcaaacagg

SEQ ID NO: 1460 - DNA, 253 bp, Unknown
  Description of Unknown: bacterium polynucleotide
  Cytophagia; Cytophagaceae
tacggagggtgcaagcgttgtccggatttattgggtttaaagggtgcgtaggtggccttataagtcagtggtgaaagcctgcagcttaactgtaggactgccattgatactgtagggcttgagtattgatgaggtaggcggaattgatagtgtagcggtgaaatgcatagatattatcaagaacaccgattgcgaaggcagcttactaaggaataactgacactgaggcacgaaagcgtggggatcaaacagg

SEQ ID NO: 1461 - DNA, 253 bp, Unknown
  Description of Unknown: bacterium polynucleotide
  Cytophagia; Cytophagaceae
tacgtagggtgcaagcgttgtccggatttattgggtttaaagggtgcgtaggcggccttgtaagtcagtggtgaaatactctagcttaactagaggggtgccattgatactgcagggtttgagttaagttgaagttggcggaattgacggtgtagcggtgaaatgcttagatatcgtcaagaacaccgatagtgaagacagctaactaaacttttactgacgctgaggcacgaaagtgtggggatcaaacagg

SEQ ID NO: 1462 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggccatgtaggccagtgctgaaatatcccggcttaactgggagggtggcattgatactgcgtggctagagtacagatgaggtaggcggaattgacggtgtagcggtgaaatgcttagatatcgtcaagaacacctatagcgaaggcagcttactaggctgtaactgacgctgaggcacgaaagtgtggggatcaaacagg

SEQ ID NO: 1463 - DNA, 253 bp, Unknown
  Description of Unknown: bacterium polynucleotide
  Cytophagia; Cytophagaceae
tacggagggtgcaagcgttgtccggatttattgggtttaaagggtgcgtaggtggtttattaagtcagtggtgaaagacggtcgcttaacgattgcagtgccattgatactgatagacttgagttttgttgaggtaggcggaattgatagtgtagcggtgaaatgcatagatattatcaagaactccaattgcgtaggcagcttactgagcaaaaactgacactgaggcacgaaagtgtgggtatcaaacagg

SEQ ID NO: 1464 - DNA, 253 bp, Unknown
  Description of Unknown: bacterium polynucleotide
  Cytophagia; Cytophagaceae
tacggagggtgcaagcgttgtccggatttattgggtttaaagggtgcgtaggcggtcttgtaagtcagtggtgaaagctagcagcttaactgttaaactgccattgatactgcaaagcttgagttcagatgaggtaggcggaatttatagtgtagcggtgaaatgcttagatactataaagaactccgatagcgtaggcagcttactaaactgatactgacgctgaggcacgaaagtgtggggatcaaacagg

SEQ ID NO: 1465 - DNA, 253 bp, Unknown
  Description of Unknown: bacterium polynucleotide
  Cytophagia; Cytophagaceae
tacgtaggtggcgagcgttgtccggatttattgggtttaaagggtgcgtaggcggtcatataagtcagtgctgtaatatcccggcttaaccgggagggtggcattgatactgtataacttgagtaaagttgaggtgggcggaattgacggtgtagcggtgaaatgcttagatatcgttaagaacaccgattgcgaaggcagctcactaagctttaactgacgctgaggcacgaaagtgggggggtcaaacagg

SEQ ID NO: 1466 - DNA, 253 bp, Unknown
  Description of Unknown: bacterium polynucleotide
  Cytophagia; Cytophagaceae
tacgtaggtggcaggcgttgtccggatttattgggtttaaagggtgcgtaggcggctctgtaagtcagtgctgaaatatcccggcttaactgggagggtggcattgatactgtggagctagagtacagatgaggtaggcggaattgacggtgtagcggtgaaatgcttagatatcgtcaagaacacctatagcgaaggcagcttactaggctgtaactgacgctgaggcacgaaagtgtggggatcaaacagg

SEQ ID NO: 1467 - DNA, 253 bp, Unknown
  Description of Unknown: bacterium polynucleotide
  Cytophagia; Cytophagaceae
tacgtagggtgcaagcgttgtccggatttattgggtttaaagggtgcgtaggcggcctattaagtcagtggtgaaatatctcagcttaactgagaaggtgccaatgatactgatgggcttgagtacagatgaggtaggcggaattgacggtgtagcggtgaaatgcttagatatcgtcaagaacacctatagcgaaggcagcttactaggctgtaactgacgctgaggcacgaaagtgtggggatcaaacagg

SEQ ID NO: 1468 - DNA, 253 bp, Unknown
  Description of Unknown: bacterium polynucleotide
  Cytophagia; Cytophagaceae
tacgtaggtggcgagcgttgtccggatttattgggtttaaagggtgcgtaggcggttctttaagtcagtgctgaaatactctagcttaactagaggggtggcattgatactgaggaacttgagtggagtcgaggtaggcggaattgacggtgtagcggtgaaatgcttagatatcgtcaagaacaccgatagtgtagacagcttactaaagagtaactgacgctgaggcacgaaagtgtggggatcaaacagg

SEQ ID NO: 1469 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggtctattaagtcagtggtgaaatactctagctcaactagaggggtgccattgatactgatggacttgagtacagatgaggtaggcggaattgacggtgtagcggtgaaatgcttagatatcgtcaagaacaccgatagcgaaggcagcttaccaagcagtaactgacgctgaggcacgaaagtgcggggatcaaacagg

SEQ ID NO: 1470 - DNA, 253 bp, Unknown
  Description of Unknown: bacterium polynucleotide
  Cytophagia; Cytophagaceae
tacgtaggtggcgagcgttgtccggatttattgggtttaaagggtgcgtaggcggccctgtaagtcagtggtgaaatatcgcagctcaactgtgagggtgccattgatactgcagggcttgagtgaatttgaggtaggcggaattgacggtgtagcggtgaaatgcttagatatcgtcaagaacaccgatagtgaagacagcttaccaagcttcaactgacgctgatgcacgaaagtgtggggatcaaacagg

SEQ ID NO: 1471 - DNA, 253 bp, Unknown
  Description of Unknown: bacterium polynucleotide
  Cytophagia; Cytophagaceae
tacgtaggtggcaagcgttgtccggatttactgggtttaaagggtgcgtaggcggtcctataagtcagttgtgaaatacggcagcttaactgtcgaggtgcaattgatactgcaggacttgagtacagacgaggtaggcggaattgacggtgtagcggtgaaatgcttagatatcgtcaagaacaccgatagcgaaggcagcttactagactgtaactgtcgctgatgcacgaaagtgtggggatcaaacagg

SEQ ID NO: 1472 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggccacttaagtcagtgctgaaatactctagcttaactagaggggtggcattgatactgattggcttgagtgaagtcgaggtaggcggaattgacggtgtagcggtgaaatgcttagatatcgtcaagaacaccgatagtgaagacagcttactagacttcaactgacgctgaggcacgaaagtgtggggatcaaacagg

SEQ ID NO: 1473 - DNA, 253 bp, Unknown
  Description of Unknown: bacterium polynucleotide
  Cytophagia; Cytophagaceae
tacggagggtgcaagcgttgtccggatttattgggtttaaagggtgcgtaggcggggtcttaagtcagtggtgaaagccggcagctcaactgtcgaattgccattgatactggggtccttgaattcagttgaggtatgcggaattgatggtgtagcggtgaaatgcatagatatcgtccagaacaccgatagcgatggcagcttactaaagagtaactgacgctgaggcacgaaagtgtggggatcaaacagg

SEQ ID NO: 1474 - DNA, 253 bp, Unknown
  Description of Unknown: bacterium polynucleotide
  Cytophagia; Cytophagaceae
tacgtaggtggcgagcgttgtccggatttattgggtttaaagggtgcgtaggcggccctgtaagtcagtgctgaaatatctcggcttaaccgagagggtggcactgatactgcagggcttgagtacagatgaggtaggcggaattgacggtgtagcggtgaaatgcatagatatcgtcaagaacaccgatagcgaaggcagcttactgggctgtaactgacgctgatgcacgaaagtgtggggatcaaacagg

SEQ ID NO: 1475 - DNA, 253 bp, Unknown
  Description of Unknown: bacterium polynucleotide
  Cytophagia; Cytophagaceae
tacgtaggtggcaagcgttgtccggatttattgggtttaaagggtgcgtaggcggccttttaagtcagtgctgaaatatcccggcttaaccgggagggtggcattgatactgaaaggcttgagtaaagttgaggtaggcggaattgacggtgtagcggtgaaatgcttagatatcgtcaagaacaccggtagtgtagacagcttactaagctttaactgacgctgaggcacgaaagtgtggggatcaaacgag

SEQ ID NO: 1476 - DNA, 253 bp, Unknown
  Description of Unknown: bacterium polynucleotide
  Cytophagia; Cytophagaceae
tacggagggtgcaagcgttgtccggatttattgggtttaaagggtgcgtaggcggccccttaagtcagtggtgaaagcccgcggctcaaccgcggaactgccattgatactggggggcttgagtacagacgaggtaggcggaattgaagatgtagcggtgaaatgcttagatatcttcaagaaccccgattgcgtaggcagcttactaggctgtaactgacgctgaggcacgaaagcgtggggagcgaacagg

SEQ ID NO: 1477 - DNA, 253 bp, Unknown
  Description of Unknown: bacterium polynucleotide
  Cytophagia; Cytophagaceae
tacggagggtgcaagcgttgtccggatttattgggtttaaagggtgcgtaggcggcccattaagtcagtggtgaaagcccggggctcaaccccggaaccgccattgatactggtgggcttgagtatggacgaggttggcggaattgagggtgtagcggtgaaatgcttagataccctcaagaacaccgattgcgtaggcagctaactaggccataactgacgctgaggcacgaatgcgtggggagcgaacagg

SEQ ID NO: 1478 - DNA, 253 bp, Adhaeribacter sp.
  Cytophagia; Cytophagaceae; Adhaeribacter
tacggagggtgcaagcgttgtccggatttattgggtttaaagggtgcgtaggcggcccgttaagtcagtggtgaaagcctccagctcaactggagaactgccattgatactgacgggcttgagtacagacgaggttggcggaattgattgtgtagcggtgaaatgcatagatacaatcaagaactccgattgcgtaggcagctaactaggctgtaactgacgctgaggcacgaaagcgtggggagcgaacagg

SEQ ID NO: 1479 - DNA, 253 bp, Adhaeribacter sp.
  Cytophagia; Cytophagaceae; Adhaeribacter
tacgtagggggcaagcgttgtccggaattattgggtttaaagggtgcgtaggcggcccgttaagtccgtggtgaaagccaacagctcaactgttgaactgccatggatactgacgggcttgagtacagacgaggtaggcggaatggatggtgtagcggtgaaatgcatagataccatccagaacaccgattgcgtaggcagcttactaggctgtaactgacgctgaggcacgaaagcgtggggagcgaacagg

SEQ ID NO: 1480 - DNA, 253 bp, Adhaeribacter sp.
  Cytophagia; Cytophagaceae; Adhaeribacter
tacgtagggtgcaagcgttgtccggatttattgggtttaaagggtgcgtaggcggctttataagtccgtggtgaaagccaacagctcaactgttgaactgccatggatactgtagggcttgagtacagacgaggtaggcggaattgatgctgtagcggtgaaatgcatagatagcatcaagaacaccgattgcgtaggcagcttactaggctgtaactgacgctgaggcacgaaagcgtggggagcgaacagg

SEQ ID NO: 1481 - DNA, 253 bp, Cytophaga sp.
  Cytophagia; Cytophagaceae; Cytophaga
tacgtaggtggcaagcgttgtccggatttattgggtttaaagggtgcgtaggcggcttgataagtcagtggtgaaagccgatcgcttaacgatcgaactgccattgatactgtcgggcttgagtatagatgaggtaggcggaattgacagtgtagcggtgaaatgcatagatattgtcaagaacaccaattgcgaaggcagcttactaagttataactgacgctgaggcacgaaagtgcggggatcaaacagg

SEQ ID NO: 1482 - DNA, 253 bp, Cytophaga sp.
  Cytophagia; Cytophagaceae; Cytophaga
tacgtaggtggcaagcgttgtccggatttattgggtttaaagggtgcgtaggcggcttaataagtcagtggtgaaagccgatcgcttaacgatcgaactgccattgatactgctaggcttgagtatagttgaggtaggcggaattgacagtgtagcggtgaaatgcatagatactgtcaagaacaccaattgcgaaggcagcttactaaagtataactgacgctgaggcacgaaagtgcggggatcaaacagg

SEQ ID NO: 1483 - DNA, 253 bp, Dyadobacter sp.
  Cytophagia; Cytophagaceae; Dyadobacter
tacggagggtgcgagcgttgtccggatttattgggtttaaagggtgcgtaggtggcctgttaagtcagtggtgaaatacggttgctcaacaatcgaggtgccattgatactgaccggcttgaaataattggaggctgccggaatggatggtgtagcggtgaaatgcatagatatcatccaggacaccgattgcgaaggcaggtggctacgattggtttgacactgaggcacgagagcatggggagcaaacagg

SEQ ID NO: 1484 - DNA, 253 bp, Dyadobacter sp.
  Cytophagia; Cytophagaceae; Dyadobacter
tacggagggtgcgagcgttgtccggatttattgggtttaaagggtgcgtaggtggctttttaagtcagtggtgaaatacagccgctcaacggttgaggtgccattgatactgaagagcttgaaacaagtggaggctgccggaatggatggtgtagcggtgaaatgcatagatatcatccagaacaccgattgcgaaggcaggtggctacgtttgatttgacactgaggcacgaaagcatggggagcaaacagg

SEQ ID NO: 1485 - DNA, 253 bp, Dyadobacter sp.
  Cytophagia; Cytophagaceae; Dyadobacter
tacggagggtgcgagcgttgtccggatttattgggtttaaagggtgcgtaggtggctaattaagtcagtggtgaaatacagccgctcaacggttgaggtgccattgatactgattagcttgaaataattggaggctgccggaatggatggtgtagcggtgaaatgcatagatatcatccagaacaccgattgcgaaggcaggtggctacgatttatttgacactgaggcacgaaagcatggggagcaaacagg

SEQ ID NO: 1486 - DNA, 254 bp, Emticicia sp.
  Cytophagia; Cytophagaceae; Emticicia
tacgtaggtggcgagcgttatccggatttattgggtttaaagggtgcgtaggcggctgattaagtcagcggtgaaaggtagcagcttaactgttttacatgccgttgatactggttagcttgagttgacagaaggcagatagaatttctggtgtagcggtgaaatgcttagataccaggaggaataccgattgcgaaggcagtctgctgcagtcacactgacgctgaggcacgaaagtgcggggatcaaacagg

SEQ ID NO: 1487 - DNA, 254 bp, Emticicia sp.
  Cytophagia; Cytophagaceae; Emticicia
tacgtaggtgtcaagcgttatccggatttattgggtttaaagggtgcgtaggcggtttaataagtcagtggttaaaggtagcagcttaactgttttacatgccactgatactgttgaacttgagttgacagaaggcagatagaatttctggtgtagcggtgaaatgcttagataccagaaggaataccgattgcgaaggcagtctgctgcagtcacactgacgctgaggcacgaaagtgcggggatcaaacagg

SEQ ID NO: 1488 - DNA, 253 bp, Flectobacillus sp.
  Cytophagia; Cytophagaceae; Flectobacillus
tacggagggtgcaagcgttgtccggatttattgggtttaaagggtgcgtaggcggctttttaagtcagcggtgaaagactgtcgctcaacgacggaactgccgttgatactgggaggcttgagtatgattgaggtagccggaatggatagtgtagcggtgaaatgcatagatattatccagaacgccaatagcgtaggcaggttactaagtcacaactgacgctgaggcacgaaagtgcggggatcaaacagg

SEQ ID NO: 1489 - DNA, 253 bp, Flectobacillus sp.
  Cytophagia; Cytophagaceae; Flectobacillus
tacggagggtgcaagcgttgtccggatttattgggtttaaagggtgcgtaggcggtttattaagtcagtggtgaaagacggtcgctcaacgattgcagtgccattgatactggtagacttgagtatgattgaggtagctggaatggatagtgtagcggtgaaatgcatagatattatccagaacaccaattgcgtaggcaagttactaagtcataactgacgctgaggcacgaaagtgtgggtatcaaacagg

SEQ ID NO: 1490 - DNA, 253 bp, Hymenobacter sp.
  Cytophagia; Cytophagaceae; Hymenobacter
tacggagggtgcgagcgttgtccggatttattgggtttaaagggtgcgtaggcggccccgtaagtccgaggtgaaagcccgttgctcaacaacggaactgccttggatactgcggggcttgagtacagacgaggttggcggaatggaccgagtagcggtgaaatgcatagatacggtccagaaccccgattgcgaaggcagctgactaggctgttactgacgctgaggcacgacagcgtggggagcgaacagg

SEQ ID NO: 1491 - DNA, 253 bp, Hymenobacter sp.
  Cytophagia; Cytophagaceae; Hymenobacter
tacggagggtgcgagcgttgtccggatttattgggtttaaagggtgcgtaggcggccttataagtccggggtgaaagcccgttgctcaacaacggaactgccctggatactgtgaggcttgagtacagacgaggttggcggaatggaccgagtagcggtgaaatgcatagatacggtccagaaccccgattgcgaaggcagctgactaggctgatactgacgctgaggcacgacagcgtggggagcgaacagg

SEQ ID NO: 1492 - DNA, 253 bp, Hymenobacter sp.
  Cytophagia; Cytophagaceae; Hymenobacter
tacggagggtgcgagcgttgtccggatttattgggtttaaagggtgcgtaggcggcccgttaagtccggggtgaaagcccgctgctcaacagcggaactgccctggatactgacgggcttgagtacagacgaggttggcggaatggaccgagtagcggtgaaatgcatagatacggtccagaaccccgattgcgaaggcagctgactaggctgttactgacgctgaggcacgaaagcgtggggagcgaacagg

SEQ ID NO: 1493 - DNA, 253 bp, Hymenobacter sp.
  Cytophagia; Cytophagaceae; Hymenobacter
tacggagggtgcgagcgttgtccggatttattgggtttaaagggtgcgtaggcggctttgtaagtctggggtgaaagcccgctgctcaacagcggaactgccctggatactgcggagcttgaggacagacgaggttggcggaatagagggtgtagcggtgaaatgcatagataccctctagaaccccgattgcgaaggcagctgactagaccgtatctgacgctgaggcacgaaagcgtggggagcgaacagg

SEQ ID NO: 1494 - DNA, 253 bp, Hymenobacter sp.
  Cytophagia; Cytophagaceae; Hymenobacter
tacggagggtgcgagcgttgtccggatttattgggtttaaagggtgcgtaggcggctttttaagtctggggtgaaagcccgctgctcaacagcggaactgccctggatactggagagcttgagtacagacgaggttggcggaatggactgagtagcggtgaaatgcatagatacagtccagaaccccgattgcgaaggcagctgactaggctgttactgacgctgaggcacgaaagcgtggggagcgaacagg

SEQ ID NO: 1495 - DNA, 253 bp, Hymenobacter sp.
  Cytophagia; Cytophagaceae; Hymenobacter
tacggagggtgcaagcgttgtccggatttattgggtttaaagggtgcgtaggcggtccgttaagtccggggtgaaagcccactgctcaacagtggaactgccctggaaactggcggacttgagtacagacgaggttggcggaatggatgctgtagcggtgaaatgcatagatagcatccagaaccccgattgcgaaggcagctgactaggctgtaactgacgctgaggcacgaaagcgtggggagcgaacagg

SEQ ID NO: 1496 - DNA, 253 bp, Hymenobacter sp.
  Cytophagia; Cytophagaceae; Hymenobacter
tacggagggtgcaagcgttgtccggatttattgggtttaaagggtgcgtaggtggcctgttaagtccggggtgaaagcccacagctcaactgtggaactgccctggatactggcgggcttgagagtagtggaggttggcggaatagaggctgtagcggtgaaatgcatagatagcctctagaaccccgattgcgaaggcagctgactacgctacatctgacactgaggcacgaaagcgtggggagcgaacagg

SEQ ID NO: 1497 - DNA, 253 bp, Hymenobacter sp.
  Cytophagia; Cytophagaceae; Hymenobacter
tacggagggtgcaagcgttgtccggatttattgggtttaaagggtgcgtaggtggccctgcaagtccgtggtgaaagcctgctgctcaacagcagaactgccatggatactacagggcttgagtccagacgaggttggcggaatggatggtgtagcggtgaaatgcatagataccatccagaaccccgattgcgtaggcagctgactaggctggtactgacactgaggcacgaaagcgtggggagcgaacagg

SEQ ID NO: 1498 - DNA, 253 bp, Hymenobacter sp.
  Cytophagia; Cytophagaceae; Hymenobacter
tacggagggtgcaagcgttgtccggatttattgggtttaaagggtgcgtaggcggtcctgtaagtctggggtgaaagcccgttgctcaacaacggaactgccctggaaactgcgggacttgagtacagacgagggtggcggaatggatgctgtagcggtgaaatgcatagatagcatccagaaccccgattgcgaaggcagctgcctagactgtaactgacgctgaggcacgaaagcgtggggagcgaacagg

SEQ ID NO: 1499 - DNA, 253 bp, Hymenobacter sp.
  Cytophagia; Cytophagaceae; Hymenobacter
tacggagggtgcaagcgttgtccggatttattgggtttaaagggtgcgtaggcggcccgttaagtccggggtgaaagcccacagctcaactgtggaactgccctggatactggcgggcttgagtccagacgaggttggcggaatggatgctgtagcggtgaaatgcatagatagcatccagaaccccgattgcgaaggcagctgactaggctggtactgacgctgaggcacgaaagcgtggggagcgaacagg

SEQ ID NO: 1500 - DNA, 253 bp, Hymenobacter sp.
  Cytophagia; Cytophagaceae; Hymenobacter
tacggagggtgcgagcgttgtccggatttattgggtttaaagggtgcgtaggcggctttataagtctggggtgaaagcccgctgctcaacagcggaactgccctggatactgtaaggcttgaggacagacgaggttggcggaatagaagctgtagcggtgaaatgcatagatagcttctagaaccccgattgcgaaggcagctgactagactgtaactgacgctgaggcacgaaagcgtagggagcgaacagg

SEQ ID NO: 1501 - DNA, 253 bp, Hymenobacter sp.
  Cytophagia; Cytophagaceae; Hymenobacter
tacggagggtgcaagcgttgtccggatttattgggtttaaagggtgcgtaggcggccgtttaagtctggggtgaaagcccgttgctcaacaacggaactgccctggaaactggacggcttgagtacagacgaggttggcggaatggatgctgtagcggtgaaatgcatagatagcatccagaaccccgattgcgaaggcagctgactaggctgtaactgacgctgaggcacgaaagcgtggggagcgaacagg

SEQ ID NO: 1502 - DNA, 253 bp, Hymenobacter sp.
  Cytophagia; Cytophagaceae; Hymenobacter
tacggagggtgcaagcgttgtccggatttattgggtttaaagggtgcgtaggcggctgattaagtctggggtgaaagcccgttgctcaacaacggaactgccctggaaactggttagcttgagtacagacgagggtggcggaatggatgctgtagcggtgaaatgcatagatagcatccagaaccccgattgcgaaggcagctgcctagactgtaactgacgctgaggcacgaaagcgtggggagcgaacagg

SEQ ID NO: 1503 - DNA, 253 bp, Hymenobacter sp.
  Cytophagia; Cytophagaceae; Hymenobacter
tacgtagggcgcaagcgttgtccggatttatcgggtttaaagggtgcgtaggcggcccgttaagtccggggtgaaagcccgttgctcaacaacggaactgccctggatactgacaggcttgagtacagacgaggttggcggaatggaccgagtagcggtgaaatgcatagatacggtccagaaccccgattgcgaaggcagctgactaggctgttattgacgctgaggcacgaaagcatggggatcaaacagg

SEQ ID NO: 1504 - DNA, 253 bp, Hymenobacter sp.
  Cytophagia; Cytophagaceae; Hymenobacter
tacggagggtgcgagcgttgtccggatttattgggtttaaagggtgcgtaggcggccttttaagtccggggtgaaagcccgttgctcaacaacggaactgccctggatactggaaggcttgagtacagacgaggttggcggaatggactgagtagcggtgaaatgcataggtacagtccagaaccccgattgcgaaggcagctgactaggctgttactgacgctgaggcacgaaagcgtggggggcgaacagg

SEQ ID NO: 1505 - DNA, 253 bp, Hymenobacter sp.
  Cytophagia; Cytophagaceae; Hymenobacter
tacggagggtgcgagcgttgtccggatttattgggtttaaagggtgcgtaggcggctccttaagtccggggtgaaagcccgttgctcaacaacggaactgccctggatactgaggagcttgagtacagacgaggttggcggaatggactgagtagcggtgaaatgcatagatacagtccagaaccccgattgcgaaggcagctgactaggctgttactgacgctgaggcacgacagcgtggggagcgaacagg

SEQ ID NO: 1506 - DNA, 253 bp, Hymenobacter sp.
  Cytophagia; Cytophagaceae; Hymenobacter
tacggagggtgcaagcgttgtccggatttattgggtttaaagggtgcgtaggtggcttgttaagtccggggtgaaagcccacagctcaactgtggaactgccctggatactggcgagcttgagtccagacgaggttggcggaatggaagctgtagcggtgaaatgcatagatagcttccagaaccccgattgcgtaggcagctgactaggctggtactgacactgaggcacgaaagcgtggggagcgaacagg

SEQ ID NO: 1507 - DNA, 253 bp, Hymenobacter sp.
  Cytophagia; Cytophagaceae; Hymenobacter
tacggagggtgcgagcgttgtccggatttattgggtttaaagggtgcgtaggcggctgtttaagtccggggtgaaagcccgttgctcaacaacggaactgccctggatactggacagcttgagtacagacgaggttggcggaatggaccgagtagcggtgaaatgcatagatacggtccagaaccccgattgcgaaggcagctgactagactgatactgacgctgaggcacgacagcgtggggagcgaacagg

SEQ ID NO: 1508 - DNA, 253 bp, Hymenobacter sp.
  Cytophagia; Cytophagaceae; Hymenobacter
tacggagggtgcaagcgttgtccggatttattgggtttaaagggtgcgtaggcggccgtttaagtccggggtgaaagcccactgctcaacagtggaactgccctggaaactggacggcttgagtacagacgagggcggcggaatggaaggtgtagcggtgaaatgcatagataccttccagagccccgattgcgaaggcagctgcctagactgtaactgacgctgaggcacgaaagcgtggggagcgaacagg

SEQ ID NO: 1509 - DNA, 253 bp, Larkinella sp.
  Cytophagia; Cytophagaceae; Larkinella
tacggagggtgcaagcgttgtccggatttattgggtttaaagggtgcgtaggtgggtttttaagtctgacctgaaagtgggccgctcaacggcacagggtggttggatactgaagaccttgaagacggtggaggctcttggaacggattgtgtagcggtgaaatgcatagagatgatccagaaccccgattgcgtaggcagggagctacgccgttcttgacactgaggcacgagagcatggggagcaaacagg

SEQ ID NO: 1510 - DNA, 254 bp, Leadbetterella sp.
  Cytophagia; Cytophagaceae; Leadbetterella
tacgtaggtggcgagcgttatccggatttattgggtttaaagggtgcgtaggcggcttaataagtcggtggtcaaaggtagcagcttaactgttttacatgccaccgatactgttgagcttgagatatgtggaggcagatggaatttccggtgtagcggtgaaatgcatagataccggaaggaactcctattgcgaaggcaatctgctacagataaactgacgctgatgcacgaaagcgtggggatcaaacagg

SEQ ID NO: 1511 - DNA, 253 bp, Rhodocytophaga sp.
  Cytophagia; Cytophagaceae; Rhodocytophaga
tacgtaggtggcaagcgttgtccggatttattgggtttaaagggtgcgtaggcggtctattaagtcaggggtgatagactattgcttaacaatggcagtgcctttgatactgataggcttgagtacagctgaggcagatggaacgggtggtgtagcggtgaaatgcatagataccatccagaacaccgattgcgaaggcagtctgctaaactgtaactgacgctgaggcacgaaagcgtggggatcgaacagg

SEQ ID NO: 1512 - DNA, 253 bp, Rhodocytophaga sp.
  Cytophagia; Cytophagaceae; Rhodocytophaga
tacggagggtgtaagcgttgtccggatttattgggtttaaagggtgcgtgggcggcttattaagtcaggggtgaaagactgcagctcaactgtagcagtgcctttgatactgatgagcttgagtacagatgaggctggcggaatgggtggtgtagcggtgaaatgcatagataccatccagaacaccgattgcgaaggcagccggctaaactgtaactgacgctgaggcacgaaagcgtggggatcgaacagg

SEQ ID NO: 1513 - DNA, 253 bp, Rudanella sp.
  Cytophagia; Cytophagaceae; Rudanella
tacggagggtgcaagcgttgtccggatttattgggtttaaagggtgcgtaggcgggtagttaagtctggttttaaagcgggtcgcttaacgatccaaggtggctggatactgattatcttgaaatcgttggaggcagccggaacgggtcgtgtagcggtgaaatgcatagagatgacccagaacaccaattgcgtaggcaggctgctacgactgatttgacgctgaggcacgagagcatggggagcaaacagg

SEQ ID NO: 1514 - DNA, 253 bp, Rudanella sp.
  Cytophagia; Cytophagaceae; Rudanella
tacggagggtgcaagcgttgtccggatttattgggtttaaagggtgcgtaggtggcctgttaagtctgctctgaaagttggtcgcttaacgatcaagggtgggtggatactggcgggcttggatcaggtggcggtttctggaacgggtcgtgtagcggtgaaatgcatagatatgacccagaactccgattgcgaaggcaggaggctacgcctggattgacactgaggcacgagagcatggggagcaaacagg

SEQ ID NO: 1515 - DNA, 253 bp, Siphonobacter aquaeclarae
  Cytophagia; Cytophagaceae; Siphonobacter aquaeclarae
tacgtagggtgcaagcgttgtccggatttattgggtttaaagggtgcgtaggcggtttattaagtcagtggtgaaagacgatcgctcaacgattgcagtgccattgatactggtaaacttgagtagtgcagaggtagctggaattgatcgtgtagcggtgaaatgcatagatatgatcaagaacgccaattgcgaaggcaggttactggacactcactgacgctgaggcacgaaagtgtggggatcaaacagg

SEQ ID NO: 1516 - DNA, 253 bp, Siphonobacter aquaeclarae
  Cytophagia; Cytophagaceae; Siphonobacter aquaeclarae
tacgtagggtgcaagcgttgtccggatttattgggtttaaagggtgcgtaggcggtggattaagtcagtggtgaaagacgatcgctcaacgattgcagtgccattgatactggttcacttgagtagtgcagaggtggccggaattgatcgtgtagcggtgaaatgcatagatatgatcaagaacgccgattgcgaaggcaggtcactggacacttactgacgctgaggcacgaaagtgtggggatcaaacagg

SEQ ID NO: 1517 - DNA, 253 bp, Spirosoma sp.
  Cytophagia; Cytophagaceae; Spirosoma
tacggagggtgcaagcgttgtccggatttattgggtttaaagggtgcgtaggtggttttttaagtctggtttgaaagctggtcgcttaacgatcagatgtggctggaaactgaggaacttgaatgcgttggcggtagccggaacgggtcatgtagcggtgaaatgcatagatatgacccagaacaccgattgcgaaggcaggctactacgacgtgattgacactgaggcacgagagcatgggtagcgaacagg

SEQ ID NO: 1518 - DNA, 253 bp, Spirosoma sp.
  Cytophagia; Cytophagaceae; Spirosoma
tacggagggtgcaagcgttgtccggatttattgggtttaaagggtgcgtaggtggtagcccaagtctggtttgaaagctggtcgctcaacgatcagatgtggctggaaactgggttacttgaatggattggcggtagccggaatgggtcatgtagcggtgaaatgcatagatatgacccggaaccccgattgcgaaggcaggctactacgatttgattgacactgaggcacgagagcatgggtagcgaacagg

SEQ ID NO: 1519 - DNA, 253 bp, Spirosoma sp.
  Cytophagia; Cytophagaceae; Spirosoma
tacggagggtgcaagcgttgtccggatttattgggtttaaagggtgcgtaggtgggacttcaagtctggtttgaaagctggtggctcaaccatcagatgtggctggaaactgaggttcttgaatggcgtagcggtagccggaatgggtcatgtagcggtgaaatgcatagatatgacccggaactccgattgcgaaggcaggctactgggcgccgattgacactgaggcacgagagcatgggtagcaaacagg

SEQ ID NO: 1520 - DNA, 253 bp, Spirosoma sp.
  Cytophagia; Cytophagaceae; Spirosoma
tacggagggtgcaagcgttgtccggatttattgggtttaaagggtgcgcaggtgggtatttaagtctggtttgaaagcaggtggctcaaccatctgatgtggctggaaactggatatcttgaatgggttggcggtagccggaatgggtcatgtagcggtgaaatgcatagatatgacccggaacaccgattgcgaaggcaggctactacgacttgattgacactggggcacgagagcatgggtagcgaacagg

SEQ ID NO: 1521 - DNA, 253 bp, Spirosoma sp.
  Cytophagia; Cytophagaceae; Spirosoma
tacggagggtgcaagcgttgtccggatttattgggtttaaagggtgcgtaggtggttttttaagtctggtttgaaagctggctgctcaacagtcagatgtggctggaaactgaagaacttgaataatttggcggtagccggaacgggtcatgtagcggtgaaatgcatagatatgacccagaaccccgattgcgaaggcaggctactacgagttgattgacactgaggcacgagagcatggggagccagcagg

SEQ ID NO: 1522 - DNA, 254 bp, Sporocytophaga sp.
  Cytophagia; Cytophagaceae; Sporocytophaga
tacggagggtgcaagcgttgtccggatttattgggtttaaagggtgcgtaggcggctttttaagtcagtggtgaaatactgcagctcaactgttagaactgccattgatactgggaagcttgagtacagacgaggtaggcggaattgacagtgtagcggtgaaatgcttagatattgtcaagaacacctattgcgaaggcagcttactagactgtaactgacgctgaggcacgaaagcgtggggatcaaacagg

SEQ ID NO: 1523 - DNA, 253 bp, Unknown
  Description of Unknown: bacterium polynucleotide
  Cytophagia; Flammeovirgaceae
tacggagggtgcaagcgttgtccggattcattgggtttaaagggtgcgtaggcgggttattaagtcagtggtgaaagccggcagctcaactgtcgaactgccattgatactggtaatcttgaattcagttgaggtatgcggaattgatggtgtagcggtgaaatgcatagataccatcaggaacaccgattgcgaaggcagcatactgggcttgaattgacgctgaggcacgaaagtgtggggatcgaacagg

SEQ ID NO: 1524 - DNA, 253 bp, Unknown
  Description of Unknown: bacterium polynucleotide
  Cytophagia; Flammeovirgaceae
tacggagggtgcaagcgttgtccggatttattgggtttaaagggtacgtaggtgggtctttaagtccgtggtgaaagcccgcagcttaactgtggaattgccatggatactggagaccttgaattcagttgaggttggcggaatttatggtgtagcggtgaaatgcatagataccataaagaacacctattgcgaaggcagctaactggacttgaattgacactgaggtacgaaagcgtggggagcgaacagg

SEQ ID NO: 1525 - DNA, 253 bp, Unknown
  Description of Unknown: bacterium polynucleotide
  Cytophagia; Flammeovirgaceae
tacggagggtgcaagcgttgtccggatttattgggtttaaagggtgcgtaggcgggctactaagtcagtggtgaaagccggcagctcaactgtcgaactgccattgatactgatagccttgagtacagatgaggtgggcggaatttatggtgtagcggtgaaatgcatagataccataaagaacaccgatagcgaaggcagctcactaaactgtaactgacgctgaggcacgaaagcatggggatcgaacagg

SEQ ID NO: 1526 - DNA, 253 bp, Unknown
  Description of Unknown: bacterium polynucleotide
  Cytophagia; Flammeovirgaceae
tacggagggtgcaagcgttgtccggatttattgggtttaaagggtgcgtaggcggctaattaagtcagtggtgaaagcctgtagctcaactatagaactgccattgatactgattagcttgagtatggttgaggtaagcggaatggatggtgtagcggtgaaatgcatagatatcatccagaacaccgatagcgaaggcagcttactgggccgaaactgacgctgaggcacgaaagcatggggatcgaacagg

SEQ ID NO: 1527 - DNA, 253 bp, Unknown
  Description of Unknown: bacterium polynucleotide
  Cytophagia; Flammeovirgaceae
tacggagggtgcaagcgttgtccggatttattgggtttaaagggtacgtaggcggccgattaagtcagtggtgaaagccgacagctcaactgtcgaacagccattgatactggttggcttgagttctgttaaggtaggcggaattgatggtgtagcggtgaaatgcatagataccatcaggaacaccgattgcgaaggcagcttactgggcatgaactgacgctaatgtacgaaagcgtggggatcgaacagg

SEQ ID NO: 1528 - DNA, 253 bp, Unknown
  Description of Unknown: bacterium polynucleotide
  DA052
gacgtagggggccagcgttgctcggaattactgggcgtaaagggtccgtaggcggtgcggtaagtcgggagtgaaatctctgggcttaactcagaggctgcttccgaaactgccgtgctagagtgcgagagaggcaagtggaattgcgggtgtagcggtgaaatgcgtagatatccgcaggaacatccgaggcgaaagcggcttgctggatcgcaactgacgctgagggacgaaagctaggggagcaaacagg

SEQ ID NO: 1529 - DNA, 253 bp, Unknown
  Description of Unknown: bacterium polynucleotide
  DA052
tacgtagggggccagcgttgctcggaattactgggcgtaaagggtccgtaggcggtgtagcaagtcgatagtgaaatctctgggcttaacccagaggctgctaacgaaactgctgtgctagagtgtgagagaggcgagtggaattacgggtgtagcggtgaaatgcgtagatatccgtaggaacatccgaggcgaaggcggctcgctggatcacaactgacgctgagggacgaaagctaggggagcaaacagg

SEQ ID NO: 1530 - DNA, 253 bp, Unknown
  Description of Unknown: bacterium polynucleotide
  DA052
tacggggggggcaagcgttgctcggaattactgggtgtaaagggttcgtaggcggtgtggcaagtcgggagtgaaatctctgggctcaacccagagtctgcttccgaaactgctgtgcttgagtgtgggagaggcgcgtggaattgcaggtgtagcggtgaaatgcgtagatatctgcaggaacacccgtggcgaaagcggcgcgctggaccactactgacgctgaggaacgaaagctaggggagcaaacagg

SEQ ID NO: 1531 - DNA, 253 bp, Unknown
  Description of Unknown: bacterium polynucleotide
  DA052
aacgtagggggccagcgttgctcggaattactgggcgtaaagggtccgtaggcggtgtggcaagtcggaagtgaaatctctgggcttaacccagaggctgctcccgaaactgctatgctagagtgcgagagaggcgagtggaattgcgggtgtagcggtgaaatgcgtagatatccgcaggaacatccgaggcgaaagcggctcgctggatcgcaactgacgctgagggacgaaagctaggggagcaaacagg

SEQ ID NO: 1532 - DNA, 253 bp, Unknown
  Description of Unknown: bacterium polynucleotide
  DA052
gacgtagggggccagcgttgctcggaattactgggtgtaaagggttcgtaggcggtgcggcaagttgggagtgaaatctctgggctcaacccagaggctgcttccaaaactgctgtgcttgagtgtgggagaggcgcgtggaattgcaggtgtagcggtgaaatgcgtagatatctgcaggaacacccgtggcgaaagcggcgcgctggaccacaactgacgctgaggaacgaaagctaggggagcaaacagg

SEQ ID NO: 1533 - DNA, 253 bp, Unknown
  Description of Unknown: bacterium polynucleotide
  DA052
tacgtagggggccagcgttgctcggaattactgggcgtaaagggttcgtaggtggtgcagcaagttgggagtgaaatctctgggcttaacccagaggctgctttcaaaactgctgtgctcgagtgcgagagaggccagtggaattgcaggtgtagcggtgaaatgcgtagatatctgcaggaacacccgtggcgaaggcggctggctggatcgcaactgacactgaggaacgaaagctaggggagcaaacagg

SEQ ID NO: 1534 - DNA, 253 bp, Unknown
  Description of Unknown: bacterium polynucleotide
  DA052
aacgtagggggccagcgttgctcggaattactgggcgtaaagggtccgtaggcggtgcggcaagtcggaagtgaaatctctgggcttaacccagaggctgctcccgaaactgccgtgctagaggatgagagaggcaagtggaattgcgggtgtagcggtgaaatgcgtagatatccgcaggaacatccgaggcgaaagcggcttgctggatcatttctgacgctgagggacgaaagctaggggagcaaacagg

SEQ ID NO: 1535 - DNA, 252 bp, Unknown
  Description of Unknown: bacterium polynucleotide
  DA052
gacgtagggggccagcgttgttcggaattactgggtgtaagggttcgtaggcggtgtggcaagtcgggagtgaaatttctgggcttaactcagaacctgcttccgaaactgctgtgctggagtgtgggagaggcgcgtggaattgcaggtgtagcggtgaaatgcgtagatatctgcaggaacacccgtggcgaaagcggcgcgctggaccactactgacgctgaggaacgagagctaggggagcaaacagg

SEQ ID NO: 1536 - DNA, 253 bp, Deinococcus sp.
  Deinococci; Deinococcaceae; Deinococcus
tacggagggtgcaagcgttacccggaatcactgggcgtaaagggcgtgtaggcgggaacttaagtctggttttaaagaccggggctcaacctcggggatggactggatactgggtttcttgatctctggagaggtaaccggaattcctggtgtagcggtggaatgcgtagataccaggaggaacaccaatggcgaaggcaggttactggacagaagatgacgctgaggcgcgaaagtgtggggagcgaaccgg

SEQ ID NO: 1537 - DNA, 253 bp, Deinococcus sp.
  Deinococci; Deinococcaceae; Deinococcus
tacggagggtgcaagcgttacccggaatcactgggcgtaaagggcgtgtaggcggccccataagtccgactttgaagaccgaggctcaacctcgggcgtgggttggagactgtgggactagacctctggagagagaaccggaattcctggtggagcggtggaatgcgtagatcccaggaggaacaccgacggcgaaggcaggttcttggacagaaggtgacgctgaggcgcgaaagtgtggggagcaaaccgg

SEQ ID NO: 1538 - DNA, 253 bp, Deinococcus sp.
  Deinococci; Deinococcaceae; Deinococcus
tacggagggtgcaagcgttacccggaatcactgggcgtaaagggcgtgtaggcggaaacctaagtccggctttgaagaccgaggctcaacctcgggcatgggctgggtactgggtttctggacctctggagagagaactggaattcctggtgtagcggtggaatgcgtagataccaggaggaacaccaacggcgaaggcaggttcttggacagaaggtgacgctgaggcgcgaaagtgtggggagcgaaccgg

SEQ ID NO: 1539 - DNA, 253 bp, Deinococcus geothermalis
  Deinococci; Deinococcaceae; Deinococcus geothermalis
tacggagggtgcaagcgttacccggaatcactgggcgtaaagggcgtgtaggcggaaggttaagtccgactttaaagaccggggctcaaccccgggcctgggttggagactggctttctggacctctggagaggcaactggaattcctggtgtagcggtggaatgcgtagataccaggaggaacaccgatggcgaaggcaggttgctggacagaaggtgacgctgaggcgcgaaagtgtggggagcgaaccgg

SEQ ID NO: 1540 - DNA, 253 bp, Deinococcus sp.
  Deinococci; Deinococcaceae; Deinococcus
tacggagggtgcaagcgttacccggaatcactgggcgtaaagggcgtgtaggcggcctgccaagtctggttttaaagcctgcggctcaaccgcagagatggactggagactggtaggctagacctctggagagagaactggaattcctggtgtagcggtggaatgcgtagataccaggaggaacaccgatggcgaaggcaggttcttggacagaaggtgacgctgaggcgcgaaagtgtggggagcaaaccgg

SEQ ID NO: 1541 - DNA, 253 bp, Deinococcus sp.
  Deinococci; Deinococcaceae; Deinococcus
tacggagggtgcaagcgttacccggaatcactgggcgtaaaggacgtgtaggcggccccctaagtctgactttaaagactgcggctcaaccgcagcagtgggttggagactgggggactagacctgtggagaggcaactggaattcctggaggagcggtggaatgcgtagatcccaggaggaacaccaacggcgaaggcaggttgctggacacaaggtgacgctgaggcgcgaaagtgtggggagcaaaccgg

SEQ ID NO: 1542 - DNA, 253 bp, Meiothermus sp.
  Deinococci; Thermaceae; Meiothermus
tacggagggtgcgagcgttacccggatttactgggcgtaaagggcgtgtaggcggttttctaagtccggggctaaagaccagggctcaaccctgggtttgccttggatactggaaagctcgacggctggagggggcagcggaatttccggagtagcggtgaaatgcgcagataccggaaggaacgccaatagcgaaggcagctgcctggacagtacgtgacgctgaggcgcgaaagcgtggggagcaaaccgg

SEQ ID NO: 1543 - DNA, 253 bp, Meiothermus sp.
  Deinococci; Thermaceae; Meiothermus
tacggagggtgcgagcgttacccggatttactgggtgtaaagggcgtgtaggcggtctctcaagtccgatgctaaagaccgaagctcaacttcgggggtgcgttggatactgtgaggctagacggtcggagagggtagcggaatttccggagtagcggtgaaatgcgcagataccggaaggaacgccgatagcgaaagcagctacctggacgatttgtgacgctgaggcgcgaaagcgtggggagcaaaccgg

SEQ ID NO: 1544 - DNA, 253 bp, Thermus sp.
  Deinococci; Thermaceae; Thermus
tacggagggcgcgagcgttacccggatttactgggcgtaaagggcgtgtaggcggcctggggcgtcccatgtgaaaggccacggctcaaccgtggaggagcgtgggatacgctcaggctagagggtgggagagggtggtggaattcccggagtagcggtgaaatgcgcagataccgggaggaacgccgatggcgaaggcagccacctggtccacttctgacgctgaggcgcgaaagcgtggggagcaaaccgg

SEQ ID NO: 1545 - DNA, 253 bp, Thermus sp.
  Deinococci; Thermaceae; Thermus
tacggagggcgcgagcgttacccggattcactgggcgtaaagggcgtgtaggcggcctggggcgtcccatgtgaaagaccacggctcaaccgtgggggagcgtgggatacgctcaggctagacggtgggagggggtggtggaattcccggagtagcggtgaaatgcgcagataccgggaggaacgccgatggcgaaggcagccacctggtccacccgtgacgctgaggcgcgaaagcgtggggagcaaaccgg

SEQ ID NO: 1546 - DNA, 253 bp, Unknown
  Description of Unknown: bacterium polynucleotide
  Deinococci; Trueperaceae
tacggagggtgcaagcgttatccggaatcactgggcgtaaagggcgcgtaggcggtccgttaagtccgatgttaaagaccggggctcaaccccggcatggcgttggatactggcaggctagacgactggagaggaaagtagaattaccagtgtagcggtgaaatgcgtagatactggtaggaatacccattgcgaaggcagctttctggacagtttgtgacgctgaggcgcgaaagtgtggggagcaaaccgg

SEQ ID NO: 1547 - DNA, 253 bp, Truepera sp.
  Deinococci; Trueperaceae; Truepera
tacggagggtgcaagcgttatccggaatcactgggcgtaaagggcgcgtaggcggtttgttaagtccgatgttaaagaccgaggctcaacctcgacacggcgttggatactggcaagctggacggttggagaggaaggtagaattaccagtgtagcggtggaatgcgtagatactggtaggaatacccattgcgaaggcagccttctggacaacacgtgacgctgaggcgcgaaagtgtggggagcaaaccgg

SEQ ID NO: 1548 - DNA, 253 bp, Unknown
  Description of Unknown: bacterium polynucleotide
  Deltaproteobacteria
gacagagggtgcaaacgttgttcggaattactgggcgtaaagcgcgtgtaggcggctctgcaagtcggatgtgaaatcccacggctcaaccatggaagtgcattcgaaactgcagggctagagtcctggagaggaaggtggaatgcttggtgtagaggtgaaattcgtagatatcaagcggaacaccggtggcgaaggcggccttctggacagtgactgacgctgagacgcgaaagcgtggggagcaaacagg

SEQ ID NO: 1549 - DNA, 253 bp, Unknown
  Description of Unknown: bacterium polynucleotide
  Deltaproteobacteria
gacagagggtgcaaacgttgctcggaattactgggcgtaaagcgcgtgtaggcgggaagataagtcgggtgtgaaatccctgggctcaacctaggaactgcatccgaaactgcctttctggagtgatggagaggaaagcggaattcccggtgtagaggtgaaattcgtagatatcgggaggaacaccagtggcgaaggcggctttctggccatcaactgacgctgagacgcgaaagcgtggggagcaaacagg

SEQ ID NO: 1550 - DNA, 253 bp, Unknown
  Description of Unknown: bacterium polynucleotide
  Deltaproteobacteria
tacagagggtgcaagcgttgttcggaattactgggcgtaaagcgcgtgtaggcggtctgataagtcggtcgtgaaatccctaggcttaacctaggaactgcgatcgaaactgtcaggctagagtatcggaggggatggcggaattcctggtgtagaggtgaaattcgtagatatcaggaggaacacctgtggcgaaggcggccatctggaagattactgacgctgagacgcgaaagcgtggggagcaaacagg

SEQ ID NO: 1551 - DNA, 253 bp, Unknown
  Description of Unknown: bacterium polynucleotide
  Deltaproteobacteria
gacagagggtgcaaacgttgttcggaattactgggcgtaaagcgagtgtaggcggtctcataagtcaggtgtgaaagccctgggctcaacccaggaagtgcacttgatactgcgaggctagagtatcggagaggttggtggaattctcggtgtagaggtgaaattcgtagatatcgagaggaacaccggtggcgaaggcggccaactggacgaatactgacgctgagactcgaaagcgtggggagcaaacagg

SEQ ID NO: 1552 - DNA, 253 bp, Unknown
  Description of Unknown: bacterium polynucleotide
  Deltaproteobacteria
tacgaagggtgcaagcgttgctcggaattattgggcgtaaagggtaggtaggttgtcttgtttgtctaaggtgaaatcccacggcttaactgtggaagtgccttagaaacggcaagactagagtcctagaggggtttgtggaattcccggtgtagcggtgaaatgcgtagagatcgggaggaacaccagcggcgaaggcggcaaactggataggaactgacactcaactacgaaagcgtggggatcaaacagg

SEQ ID NO: 1553 - DNA, 253 bp, Unknown
  Description of Unknown: bacterium polynucleotide
  Deltaproteobacteria
gacagagggtgcaaacgttgttcggaattactgggcgtaaagcgcgtgtaggcggctaagtaagtcgggcgtgaaatcccacggctcaaccgtggaagtgcactcgaaactgcatagctagagtcctggagaggaaggtggaatgcttggtgtagaggtgaaattcgtagatatcaagcggaacaccggtggcgaaggcggccttctggacagtgactgacgctgagacgcgaaagcgtggggagcaaacagg

SEQ ID NO: 1554 - DNA, 253 bp, Unknown
  Description of Unknown: bacterium polynucleotide
  Deltaproteobacteria
tacagagggtgcaaacgttgctcggaattattgggcgtaaagcgcacgtaggtggccatgtaagtcaggagtgaaagccctcggcttaaccggggaagtgcttttgaaactgcatggcttgagtactggagagggtcgcggaattcccggtgtagaggtgaaattcgtagatatcgggaggaacaccagtggcgaaggcggcgacctggacagatactgacactgaggtgcgaaagcgtggggagcaaacagg

SEQ ID NO: 1555 - DNA, 253 bp, Unknown
  Description of Unknown: bacterium polynucleotide
  Deltaproteobacteria
tacgaagggtgcaagcgttgctcggaattattgggcgtaaagggtaggtaggtggtaataaaagtctggggtgaaatccctgagctcaactcaggacgtgccttggaaactttattactagagtgctggagaggtccgcagaattcccggtgtagcggtgaaatgcgtagagatcgggaggaataccagaggcgaaggcggcggactggacagtcactgacactcaactacgaaagcgtgggtagcaaacagg

SEQ ID NO: 1556 - DNA, 253 bp, Unknown
  Description of Unknown: bacterium polynucleotide
  Deltaproteobacteria
tacggagggtgcaagcgttgttcggaattactgggcgtaaagcgcgcgtaggcggcattataagtcgggtgtgaaatccctgggcttaacccaggacgtgcgcctgatactgtgatgctagaatctgggagagggatgtggaattcctggtgtagaggtgaaattcgtagagatcaggaggaacactcgtggcgaaggcgacatcctggaccaagattgacgctgaggcgcgaaagcgtggggagcaaacagg

SEQ ID NO: 1557 - DNA, 253 bp, Unknown
  Description of Unknown: bacterium polynucleotide
  Deltaproteobacteria
gacagagggtgcaaacgttgttcggaattactgggcgtaaagcgcgtgtgggcggccttgcaagtcggatgtgaaatcccacggctcaaccgtggaagtgcattcgaaactgcgaggctagagttctggagaggaaggtggaatgcttggtgtagaggtgaaattcgtagatatcaagcggaacaccggtggcgaaggcggccttctggacagtaactgacgctgagacgcgaaagcgtggggagcaaacagg

SEQ ID NO: 1558 - DNA, 253 bp, Unknown
  Description of Unknown: bacterium polynucleotide
  Deltaproteobacteria
tacggagggtgcaaacgttgctcggaatcattgggcgtaaagcgcacgtaggtggcctgttaagtcgggtgtgaaatccctgggctcaacccaggaagtgcactcgaaactggcaggcttgagtactgaagagggtcgcggaattcccggtgtagaggtgaaattcgtagatatcgggaggaacaccagtggcgaaggcggcgacctgggcagatactgacactgaggtgcgaaagcgtggggagcaaacagg

SEQ ID NO: 1559 - DNA, 253 bp, Unknown
  Description of Unknown: bacterium polynucleotide
  Deltaproteobacteria
gacagagggtgcaaacgttgttcggaattactgggcgtaaagcgcgtgtaggtggctatgcaagtcggatgtgaaagccctcggctcaaccggggaagtgcacccgaaactgcaaagctagagtctcggagaggatcgtggaattctcggtgtagaggtgaaattcgtagatatcgagaggaacaccggtggcgaaggcggcgatctggacgatgactgacactgagacgcgaaagcgtggggagcaaacagg

SEQ ID NO: 1560 - DNA, 252 bp, Unknown
  Description of Unknown: bacterium polynucleotide
  Deltaproteobacteria
gacagagggtgcaaacgttgttcggaattactgggcgtaaagcgcgtgtaggcggcttcgcaagtcgggtgtgaaatcccacggctcaaccgtggaagtgcactcgagactgcaaggctagagtcctggagaggaaggtggaatgcttggtgtagaggtgaaattcgtagatatcaagcggaacaccggtggcgaaggcggccttctggacagtgactgacgctgagacgcgaaagcgtgggagcaaacagg

SEQ ID NO: 1561 - DNA, 253 bp, Unknown
  Description of Unknown: bacterium polynucleotide
  Deltaproteobacteria
gacagagggtgcaaacgttgttcggaatcactgggcgtaaagcgcgtgtaggtggcttggcaagtcgggcgtgaaatcccggggctcaaccccggaagtgcactcgatactgcctcgctagagtcctggagaggaaggtggaatacttggtgtagaggtgaaattcgtagatatcaagtagaacaccggtggcgaaggcggccttctggacagtgactgacgctgagacgcgaaagcgtggggagcaaacagg

SEQ ID NO: 1562 - DNA, 253 bp, Unknown
  Description of Unknown: bacterium polynucleotide
  Deltaproteobacteria
tacagggggtgcaaacgttgctcggaatcattgggcgtaaagcgcacgtaggcggttcgttatgtcggatgtgaaagcccttggcttaaccgaggaagtgcatccgaaactggcgagctagagtactaaagaggatcgcggaattcccggtgtagaggtgaaattcgtagatatcgggaggaacaccggtggcgaaggcggcgatctgggtagatactgacgctgaggtgcgaaagcgtggggagcaaacagg

SEQ ID NO: 1563 - DNA, 253 bp, Unknown
  Description of Unknown: bacterium polynucleotide
  Deltaproteobacteria
tacagagggtgcaagcgttgttcggaatcactgggcgtaaagcgcgtgtaggtggcggggtaagtcgggtgtgaaatcccttggctcaaccaaggaagtgcactcgatactgcttcgcttgagtaccggaggggatggcggaattcccggtgtagaggtgaaattcgtagatatcgggaggaacacctgtggcgaaggcggccatctggacggtcactgacactgagacgcgaaagcgtgggtagcaaacagg

SEQ ID NO: 1564 - DNA, 253 bp, Unknown
  Description of Unknown: bacterium polynucleotide
  Deltaproteobacteria
tacagaggatgcgaacgttgctcggagttactgggcgtaaagcgcgcgtaggcggcctcgtaagtcgggtgtgaaagcccggggctcaaccccggaagggcacacgatactgcggggctggagtactggagaggagagcggaattcccggtgtagaggtgaaattcgtagatatcgggaggaacaccagtggcgaaggcggctctctggacagatactgacgctgaggcgcgaaagcgtgggaagcaaacagg

SEQ ID NO: 1565 - DNA, 253 bp, Unknown
  Description of Unknown: bacterium polynucleotide
  Deltaproteobacteria
tacgggaggtgcaagcgttgttcggagtgactgggcgtaaagcgcacgtaggtgggcttgtaagtcggatgtgaaatccctgggcttaacctgggaactgcatccgaaactataagtcttgaatgcttcagaggttggtagaattccaggtgtaggagtgaaatccgtagatatctggaggaataccggaggcgaaggcggccaactgggaatgcattgacactgaggtgcgaaagcgtggggagcaaacagg

SEQ ID NO: 1566 - DNA, 253 bp, Unknown
  Description of Unknown: bacterium polynucleotide
  Deltaproteobacteria
gacagagggtgcaaacgttgttcggaattactgggcgtaaagcgcgtgtaggcggcgacgcaagtcggatgtgaaagcccatggctcaaccatggaagtgcacccgaaactgcgtcgctagagtctcggagaggaaggtggaatgcttggtgtagaggtgaaattcgtagatatcaagcggaacaccggtggcgaaggcggccttctggacgagtactgacgctgagacgcgaaagcgtgggtagcaaacagg

SEQ ID NO: 1567 - DNA, 253 bp, Unknown
  Description of Unknown: bacterium polynucleotide
  Deltaproteobacteria
gacagagggtgcaaacgttgttcggatttactgggcgtaaagcgcgtgtaggcggcttggcaagtcggatgtgaaagcccacggctcaaccgtggaagcgcacccgaaacggcctcgctcgagtctcggagaggaaggtggaatgcttggagtagaggtgaaattcgtagatatcaagcagaacacctgcggcgaaggcggccttctggacgatgactgacgctgagacgcgaaagcgtggggagcaaacagg

SEQ ID NO: 1568 - DNA, 253 bp, Unknown
  Description of Unknown: bacterium polynucleotide
  Deltaproteobacteria
gacagagggtgcgaacgttgctcggaatcactgggcgtaaagcgcgcgtaggcggacaagaaagttgggtgtgaaatccctgggctcaacccaggaactgcattcaaaactccttgtctggagtgacggagaggatagtggaattcccggtgtagaggtgaaattcgtagatatcgggaggaacaccagtggcgaaggcggctatctggacgtccactgacgctgaggcgcgaaagcgtggggagcaaacagg

SEQ ID NO: 1569 - DNA, 253 bp, Unknown
  Description of Unknown: bacterium polynucleotide
  Deltaproteobacteria
gacagagggtgcaaacgttgctcggaattactgggcgtaaagcgcgtgtaggcgggccgacaagtcagatgtgaaatccctgagctcaactcaggaactgcatttgaaactgtcggccttgagtggtggagagggaagcggaattcctggtgtagaggtgaaattcgtagatatcaggaggaacaccggtggcgaaggcgacttcctggacaccaactgacgctgagacgcgaaagcgtggggagcaaacagg

SEQ ID NO: 1570 - DNA, 253 bp, Unknown
  Description of Unknown: bacterium polynucleotide
  Deltaproteobacteria
tacggagggggctagcgttgttcggaattactgggcgtaaagcgcgtgtaggcggccctgcaagtcgggtgtgaaatcccatggctcaaccatggaagtgcactcgaaactgcagggctagagtcctggagaggaaggtggaatgcttggtgtagaggtgaaattcgtagatatcaagcggaacaccggtggcgaaggcggccttctggacagtgactgacgctaagacgcgaaagcgtggggagcaaacagg

SEQ ID NO: 1571 - DNA, 253 bp, Unknown
  Description of Unknown: bacterium polynucleotide
  Deltaproteobacteria
gacagagggtgcaaacgttgttcggaattactgggcgtaaagcgcgtgtaggcggcagggcatgtcggatgtgaaagcccgtggctcaaccacggaagtgcacccgaaactgcccagcttgagtctcggagaggaaggcggaatgcttggtgtagaggtgaaattcgtagatatcaagcggaacaccggtggcgaaggcggccttctggacgatgactgacgctgagacgcgaaagcgtggggagcaaacagg

SEQ ID NO: 1572 - DNA, 253 bp, Unknown
  Description of Unknown: bacterium polynucleotide
  Deltaproteobacteria
tacgaaaggtccaagcgttactcggaattactgggcgtaaagcgcgcgtaggcggctttgtatgtcgattgtgaaagccccgggctcaacctgggaactgcagtcgaaactgcaaagcttgaatgttggagaggttgggggaatacctagtggagaagtgaaattcgtagagattaggtggaacaccagaggcgaaggcgcctgactggccaaacattgacgctgaggcgcgaaagcgtgggtagcaaacagg

SEQ ID NO: 1573 - DNA, 253 bp, Unknown
  Description of Unknown: bacterium polynucleotide
  Deltaproteobacteria
tacggagggtgcaagcgttaatcggaatcactgggcgtaaagggcgtgtaggcgggaatgtaagtcgggcgtgaaatccctaggctcaacctaggaactgcactcgaaactgcgtttcttgagtatcggagaggaaagcggaattccgggtgtagaggtgaaattcgtagatatccggaggaacaccagtggcgaaggcggctttctggacactaactgacgctgagatgcgaaagcgtggggagcaaacagg

SEQ ID NO: 1574 - DNA, 253 bp, Unknown
  Description of Unknown: bacterium polynucleotide
  Deltaproteobacteria
tacagagggtgcaagcgttgttcggaattattgggcgtaaagcgcgtgtaggcggcttcgcaagtcgggtgtgaaatcccccagctcaaccggggaagtgcgctcgaaactgcggagctcgagtaccggagaggatggtggaattccccaagtagaggtgaaattcgtagatatggggaggaacaccggtggcgaaggcgaccatctggacggatactgacgctgagacgcgaaagcgtgggtagcaaacagg

SEQ ID NO: 1575 - DNA, 253 bp, Unknown
  Description of Unknown: bacterium polynucleotide
  Deltaproteobacteria
tacagagggtgcaagcgttgttcggaattattgggcgtaaagggagtgtaggcggttgcctaagtcctctgtgaaatctacgggcttagcctgtaaagtgcagaggaaactgggcgacttgagtgttggagagggcaggggtatacccagtgtagaggtgaaattcgtagagattgggtggaacaccagtggcgaaggcgcctgcctggccgattactgacgctgagactcgaaagcatggggagcaaacagg

SEQ ID NO: 1576 - DNA, 253 bp, Unknown
  Description of Unknown: bacterium polynucleotide
  Deltaproteobacteria
gacagagggtgcaaacgttgttcggaattactgggcgtaaagcgcgtgtaggcggcctcgcaagtcgggcgtgaaatcccacggctcaaccgtggaagtgcactcgaaactgcgaagctggagtcctggagaggaaggtggaatgcttggtgtagaggtgaaattcgtagatatcaagcggaacaccggtggcgaaggcgaccttctggacagtgactgacgctgagacgcgaaagcgtggggagcaaacagg

SEQ ID NO: 1577 - DNA, 253 bp, Unknown
  Description of Unknown: bacterium polynucleotide
  Deltaproteobacteria
tacgaaaggtgcaagcgttactcggaatcactgggcgtaaagcgcacgtaggcggactcgtaggtcaattgtgaaatacctgggctcaacccgggaactgcagttgaaaccgcttgtcttgaatacctgagagggtgggggaatacctggtggagaagtgaaattcgtagagatcaggtggaacaccggaggcgaaggcgcctgcctggcagtgtattgacgctgaggtgcgaaagtgcggggagcaaacagg

SEQ ID NO: 1578 - DNA, 253 bp, Unknown
  Description of Unknown: bacterium polynucleotide
  Deltaproteobacteria
tacggagggtgcaagcgttgttcggattgattgggcgtaaagcgcacgtaggcgggttcgtaagtcgaatgtgaaagccctgggcttaacctgggaactgcatccgaaactatgaatcttgaatactcgagaggttggtagaattccaggtgtaggagtgaaatccgtagatatctggaggaacaccggaggcgaaggcggccgactggcgatgtattgacgctgaggtgcgaaagcgtggggagcaaacagg

SEQ ID NO: 1579 - DNA, 253 bp, Unknown
  Description of Unknown: bacterium polynucleotide
  Deltaproteobacteria
tacgaagggtgcaagcgttgctcggaattattgggcgtaaagggcaggtaggtggtcttgtttgtctaaggtgaaatccccgagcttaacttgggaactgccttggaaacggcgagactggagtactggagagggtcgtagaattctcggtgtagcggtaaaatgcgtagagatcgagaggaataccagaggcgaaggcggcgacctggacagtaactgacactcaactgcgaaagcgtggggagcaaacagg

SEQ ID NO: 1580 - DNA, 253 bp, Unknown
  Description of Unknown: bacterium polynucleotide
  Deltaproteobacteria
tacggagggtgcgagcgttgtccggaattattgggcgtaaagggcgcgtaggcggtttagtaagtcagatgtgaaatcccggggcttaactccggaagtgcatttgaaactactaggctagagtacagtagaggttattggaattcccagtgtagaggtgaaattcgtagatattgggaggaacaccagtggcgaaggcggataactgggctgtaactgacgctgaggcgcgaaagcgtggggatcaaacagg

SEQ ID NO: 1581 - DNA, 253 bp, Unknown
  Description of Unknown: bacterium polynucleotide
  Deltaproteobacteria
tacagagggtgcaagcgttgttcggaattattgggcgtaaagggagtgtaggctgtgaggtaagtcttctgtgaaatctacgggctcagcctgtaacgtgcagaggaaactgcttcgcttgagtgtcggagaggataggggaatacccagtgtagaggtgaaattcgtagagattgggtggaacaccagtggcgaaggcgcctatctggctgacaactgacgctgagactcgaaagcatggggagcaaacagg

SEQ ID NO: 1582 - DNA, 254 bp, Unknown
  Description of Unknown: bacterium polynucleotide
  Deltaproteobacteria
tacgaggggtgcaagcgttgctcggaattattgggcgtaaagggcaagtaggtggtctcatttgtctacaggtgaaagccttgagcttaactcaagaagtgccttagaaacggtgagactcgagtactggagagggtcgtggaattcccggtgtagcggtgaaatgcgtagagatcgggaggaacaccagaggcgaaggcggcgacctggacagttactgacactcaactgcgaaagcgtggggagcaaacagg

SEQ ID NO: 1583 - DNA, 253 bp, Unknown
  Description of Unknown: bacterium polynucleotide
  Deltaproteobacteria
tacagagggtgcaagcgttgttcggaattattgggcgtaaagcgcgtgtaggcggcttggcaagtcagatgtgaaagccctcggcttaaccgaggaagtgcgtctgaaactgctgagcttgagtgtcggagaggatggcggaattccgcaagtagaggtgaaattcgtagatatgcggaggaacaccggtggcgaaggcggccatctggacgactactgacgctgagacgcgaaagcgtggggagcaaacagg

SEQ ID NO: 1584 - DNA, 253 bp, Unknown
  Description of Unknown: bacterium polynucleotide
  Deltaproteobacteria
gacagagggtgcaaacgttgctcggaatcactgggcgtaaagggcgtgtaggcggacttgcaagtcaggcgtgaaatccctgggctcaacccaggaattgcacttgaaactgcaagccttgagtgtcggagaggaaagcggaattcctggtgtagaggtgaaattcgtagatatcaggaggaacaccggtggcgaaggcggctttctggacgataactgacgctgagacgcgaaagcgtggggagcaaacagg

SEQ ID NO: 1585 - DNA, 253 bp, Unknown
  Description of Unknown: bacterium polynucleotide
  Deltaproteobacteria
tacagagggtgcaagcgttgttcggaattactgggcgtaaagcgcgtgtaggcggcgttataagtcggatgtgaaagccctcggctcaaccgaggaagtgcatctgatactgtagtgcttgagtgtcggagggggtggcggaattcccggtgtagaggtgaaattcgtagatatcgggaggaacacctgtggcgaaggcggccacctggacgacaactgacgctgagacgcgaaagcgtgggtagcaaacagg

SEQ ID NO: 1586 - DNA, 253 bp, Unknown
  Description of Unknown: bacterium polynucleotide
  Deltaproteobacteria
tacagagggtgcgaacgttgctcggaattactgggcgtaaagcgcgtgtaggcgggatgataagtcggaagtgaaatccccgggctcaacccgggaactgctttcgaaactgtcgtcctcgagtaccggagagggtggcggaattcctggtgtagaggtgaaattcgtagatatcaggaggaacaccggtggcgaaggcggccacctggacggtcactgacgctgagacgcgaaagcgtggggagcaaacagg

SEQ ID NO: 1587 - DNA, 253 bp, Unknown
  Description of Unknown: bacterium polynucleotide
  Deltaproteobacteria
gacagagggtgcaaacgttgctcggaatcactgggcgtaaagggcgtgtaggcgggaatgtaagtcgggcgtgaaatccctaggctcaacctaggaactgcactcgaaactgcgtttcttgagtatcggagaggaaagcggaatacctggtgtagaggtgaaattcgtagatatcaggtggaacaccagtggcgaaggcggctttctggacgataactgacgctgagacgcgaaagcgtggggagcaaacagg

SEQ ID NO: 1588 - DNA, 253 bp, Unknown
  Description of Unknown: bacterium polynucleotide
  Deltaproteobacteria
tacggagggtgcaagcgttgctcggaattattgggcgtaaagggtaggtaggtggtctcatttgtctgaggtgaaagccttgagcttaactcaagaagtgccttagaaacggtgagactagagttctggagagggtcgtggaattcccggtgtagcggtgaaatgcgtagagatcgggaggaacaccagaggcgaaggcggcgacctggacagatactgacactcaactacgaaagcgtggggagcaaacagg

SEQ ID NO: 1589 - DNA, 253 bp, Unknown
  Description of Unknown: bacterium polynucleotide
  Deltaproteobacteria
tacagagggtgcaagcgttgctcggaattactgggcgtaaagcgtgtgtaggcggtccatcaagtggggtgtgaaatccctaggctcaacctaggaactgcgccccaaactgaaggacttgagtgtcggagaggatagtggaattcccagtgtagaggtgaaattcgtagatattgggaggaacaccagtggcgaaggcggctatctggacgaacactgacgctgagacacgaaagcgtggggagcaaacagg

SEQ ID NO: 1590 - DNA, 253 bp, Unknown
  Description of Unknown: bacterium polynucleotide
  Deltaproteobacteria
tacagagggtgcgagcgttgttcggaattactgggcgtaaagcgcgcgcaggcgggatggcaagtcgggtgtgaaagccctcggctcaaccgaggaagtgcattcgaaactgccgttcttgagtgtcggagagggtggtggaattcccggtgtagaggtgaaattcgtagatatcgggaggaacaccagtggcgaaggcgaccacctggacgaacactgacgctgaggcgcgaaagcgtggggagcaaacagg

SEQ ID NO: 1591 - DNA, 253 bp, Unknown
  Description of Unknown: bacterium polynucleotide
  Deltaproteobacteria
gacagagggtgcgaacgttgctcggaatcactgggcgtaaagcgcgcgtaggcgggcaagcaagtcggttgtgaaatccctgggctcaacccaggaactgcatccgaaactatttgtctcgagtgacggagaggatagtggaattcccggtgtagaggtgaaattcgtagatatcgggaggaacaccagtggcgaaggcggctatctggacgtctactgacgctgaggcgcgaaagcgtggggagcaaacagg

SEQ ID NO: 1592 - DNA, 253 bp, Unknown
  Description of Unknown: bacterium polynucleotide
  Deltaproteobacteria
tacgtagggtgcaagcgttgttcggaatcattgggcgtaaagcgcgtgtaggcggttaattaagtcgagtgtgaaatccctaggctcaaccaaggaagtgcattcgaaactgattagctagaagatggtagagaaaggtggaattccaagtgtagaggtgaaattcgtagatatttggaggaataccggtggcgaaggcggccttttgggccattcttgacgctgagacgcgaaagcgtgggtagcaaacagg

SEQ ID NO: 1593 - DNA, 253 bp, Unknown
  Description of Unknown: bacterium polynucleotide
  Deltaproteobacteria
gacagagggtgcgaacgttgttcggaattactgggcgtaaagcgcgtgtaggcggcagcgtgtgtcgggcgtgaaatcccatggcttaaccatggaagtgcacccgaaactgcgcagctagagtcctggagaggaagatggaatacttggtgtagaggtgaaattcgtagatatcaagtggaacaccggtggcgaaggcggtcttctggacagtgactgacgctgagacgcgaaagcgtggggagcaaacagg

SEQ ID NO: 1594 - DNA, 253 bp, Unknown
  Description of Unknown: bacterium polynucleotide
  Deltaproteobacteria
tacagagggtgcaagcgttgttcggatttactgggcgtaaagcgcgtgtaggcggtggcataagtcggatgtgaaatccctcggcttaaccgaggaagtgcacccgatactgtgtcacttgagtaccggaggggatggcggaattcccggtgtagaggtgaaattcgtagatatcgggaggaacacctgtggcgaaggcggccatctggacggtaactgacgctgagacgcgaaagcgtgggtagcaaacagg

SEQ ID NO: 1595 - DNA, 253 bp, Unknown
  Description of Unknown: bacterium polynucleotide
  Deltaproteobacteria
tacgaagggtgcaagcgttactcggaattattgggcgtaaagggtaggtaggtggtctcatttgtctggggtgaaagcctcgagcttaactcgagaagtgcctcggaaacggtgagactagagtcttggagagggtcgtggaattcccggtgtagcggtgaaatgcgtagagatcgggaggaacaccagaggcgaaggcggcgacctggacaagcactgacactcaactacgaaagcgtggggagcaaacagg

SEQ ID NO: 1596 - DNA, 253 bp, Unknown
  Description of Unknown: bacterium polynucleotide
  Deltaproteobacteria
tacggagggtgcaagcgttaatcggaattactgggcgtaaagcgcgtgtaggcggagcgctaagtcgggcgtgaaatccccaggctcaacctgggaactgcgctcgaaactgacgttctcgagtatcggagagggtggcggaattcctggtgtagaggtgaaattcgtagatatcaggaggaacaccggtggcgaaggcggccacctggacgattactgacgctgagacgcgaaagcgtggggagcaaacagg

SEQ ID NO: 1597 - DNA, 253 bp, Unknown
  Description of Unknown: bacterium polynucleotide
  Deltaproteobacteria
gacagagggtgcaaacgttgttcggaattactgggcgtaaagcgcgtgtaggcggctctgcaagtcggatgtgaaatcccacggctcaaccgtggaagtgcactcgaaactgcttggctagagtcttggagaggaaggcggaatgcttggtgtagaggtgaaattcgtagatatcaagcggaacaccggtggcgaaggcggccttctggacaatgactgacgctaaaacacgaaagcgtggggagcaaacagg

SEQ ID NO: 1598 - DNA, 253 bp, Unknown
  Description of Unknown: bacterium polynucleotide
  Deltaproteobacteria
tacgaagggtgcgagcgttgttcggaattactgggcgtaaagggttcgtaggcgggaatgcaagtcaagtgtgaaatccccaggcttaacctgggacgtgcatttgagactgtgtttcttgagtttcggagagggtggtggaattgctggtgtaggagtgacatccgtagagatcagcaggaacaccggaggcgaaggcgaccacctggccgaatactgacgctgaggaacgaaagcgtggggagcaaacagg

SEQ ID NO: 1599 - DNA, 253 bp, Unknown
  Description of Unknown: bacterium polynucleotide
  Deltaproteobacteria
tacggagggtgcaagcgttgttcggaattattgggcgtaaagggcgtgtaggtggcattccaagtctggtgtgaaagcccacggctcaaccgtggaactgcattggaaactggaaagctcgagtattggagggggtcgcggaattcccggtgtagaggtgaaattcgtagatatcgggaggaacaccagtggcgaaggcggcgacctggccaattactgacactgagacgcgaaagcgtgggtagcaaacagg

SEQ ID NO: 1600 - DNA, 253 bp, Unknown
  Description of Unknown: bacterium polynucleotide
  Deltaproteobacteria
tacgaggggtgtaagcgttgctcggaattattgggcgtaaagggttggtaggtggtcttgtttgtctaaggtgaaatcccatggcttaactgtggaagtgccttagaaacggcaagactagagccctagaggggtttgtggaattcccggtgtagcggtgaaatgcgtagagatcgggaggaacaccagcggcgaaggcggcaaactggataggaactgacactcaacaacgaaagcgtggggagcaaacagg

SEQ ID NO: 1601 - DNA, 253 bp, Unknown
  Description of Unknown: bacterium polynucleotide
  Deltaproteobacteria
gacagagggtgcaaacgttgttcggatttactgggcgtaaagcgtgtgtaggcggcttggcaagttggatgtgaaagcccacggctcaaccgtggaagcgcatccaaaactgcttcgctcgagtctcggagaggaaggtggaatgcttggtgtagaggtgaaattcgtagatatcaagcagaacacctgcggcgaaggcggccttctggacgatgactgacgctgagacacgaaagcgtggggagcaaacagg

SEQ ID NO: 1602 - DNA, 253 bp, Unknown
  Description of Unknown: bacterium polynucleotide
  Deltaproteobacteria
gacagagggtgcaaacgttgctcggaatcactgggcgtaaagggcgtgtaggcgggaaggtaagtcgggcgtgaaatccccaagctcaacttgggaactgcactcgaaactacttttcttgagtgtcggagaggaaagcggaatacctggtgtagaggtgaaattcgtagatatcaggtggaacaccagtggcgaaggcggctttctggacgattactgacgctgagacgcgaaagcgtggggagcaaacagg

SEQ ID NO: 1603 - DNA, 253 bp, Unknown
  Description of Unknown: bacterium polynucleotide
  Deltaproteobacteria
gacagagggtgcgaacgttgttcggaattactgggcgtaaagcgtgtgtaggcggcagcgcaagtcgggcgtgaaatcccacggctcaaccgtggaagtgcactcgaaactgcgcagctagagtcctggagaggaaggtggaatgcttggtgtagaggtgaaattcgtagatatcaagcggaacaccggtggcgaaggcggccttctggacagtgactgacgctgagacacgaaagcgtggggagcaaacagg

SEQ ID NO: 1604 - DNA, 253 bp, Unknown
  Description of Unknown: bacterium polynucleotide
  Deltaproteobacteria
gacagagggtgcaaacgttgttcggaattactgggcgtaaagcgtgtgtaggcggtccgctaagtcgggtgtgaaagccctgggctcaacccaggaagtgcactcgaaactggcgggctagagtaccggagaggttggtggaattctcggtgtagaggtgaaattcgtagatatcgagaggaacaccggtggcgaaggcggccaactggacggatactgacgctgagacacgaaagcgtggggagcaaacagg

SEQ ID NO: 1605 - DNA, 253 bp, Unknown
  Description of Unknown: bacterium polynucleotide
  Deltaproteobacteria
tacagagggtgcaagcgttgttcggaattactgggcgtaaagcgcgtgtaggcggtctgataagtcggtcgtgaaagcccttggcttaaccaaggaactgcgatcgaaactgccggactagagtatcggagggggtggcggaattcccggtgtagaggtgaaattcgtagatatcgggaggaacacctgtggcgaaggcggccacctggaagattactgacgctgagacgcgaaagcgtggggagcaaacagg

SEQ ID NO: 1606 - DNA, 253 bp, Unknown
  Description of Unknown: bacterium polynucleotide
  Deltaproteobacteria
tacagagggtgcaaacgttgctcggaattattgggcgtaaagcgcgtgtaggtggcacggtaagtcgactgtgaaagcccttggctcaaccaaggaagtgcagtcgaaactaccgagcttgagtcctgaagagggtggtagaatggccagtgtagaggtgaaattcgtagatattggctagaataccagtggcgaaggcgaccacctgggaaggtactgacactgagacgcgaaagcgtgggtagcaaacagg

SEQ ID NO: 1607 - DNA, 253 bp, Unknown
  Description of Unknown: bacterium polynucleotide
  Deltaproteobacteria
gacagagggtgcaaacgttgctcggaatcactgggcgtaaagggcgtgtaggcgggacggtaagtcgggcgtgaaatccctaggctcaacctaggaactgcactcgaaactaccattcttgagtgtcggagaggaaagcggaattcctggtgtagaggtgaaattcgtagatatcaggaggaacaccagtggcgaaggcggctttctggacgataactgacgctgagacgcgaaagcgtggggagcaaacagg

SEQ ID NO: 1608 - DNA, 253 bp, Unknown
  Description of Unknown: bacterium polynucleotide
  Deltaproteobacteria
gacagagggtgcaaacgttgctcggaatcactgggcgtaaagggcgtgtaggcgggaaggaaagtcagatgtgaaatccctgggctcaacccaggaactgcatttgaaactccctttcttgagtgtcggagaggaaagtggaattcctggtgtagaggtgaaattcgtagatatcaggaggaacaccggtggcgaaggcggctttctggacgacaactgacgctgagacgcgaaagcgtggggagcaaacagg

SEQ ID NO: 1609 - DNA, 253 bp, Unknown
  Description of Unknown: bacterium polynucleotide
  Deltaproteobacteria
tacatggggtgcaaacgttgctcggaattattgggcgtaaagcgcgtgtaggcggcttagcaagtcgggcgtgaaagccctcggctcaaccgaggaagtgcacccgaaactgctgagcttgagtgccggagaggatggcggaattccccaagtagaggtgaaattcgtagatatggggaggaacaccggtggcgaaggcggccatctggacggtaactgacgctgagacgcgaaagcgtggggagcaaacagg

SEQ ID NO: 1610 - DNA, 253 bp, Unknown
  Description of Unknown: bacterium polynucleotide
  Deltaproteobacteria
tacgaggggtgcaagcgttgctcggaattattgggcgtaaagggtaggtaggtggtctcatttgtccggggtgaaagccttgagcttaactcaagaagtgcctcggaaacggtgagactggagtcctggagagggtcgtggaattcccggtgtagcggtgaaatgcgtagagatcgggaggaacaccagaggcgaaggcggcgacctggacaggcactgacactcaactacgaaagcgtggggagcaaacagg

SEQ ID NO: 1611 - DNA, 253 bp, Unknown
  Description of Unknown: bacterium polynucleotide
  Deltaproteobacteria
tacatggggtgcaaacgttgctcggaattattgggcgtaaagcgcacgtaggtggtctgttatgtcggatgtgaaagccctcggctcaactgaggaagtgcatccgaaactggcaggctagagtacgaaagagggtcgcggaattcccggtgtagaggtgaaattcgtagatatcgggaggaacaccggtggcgaaggcggcgacctggttcgatactgacactgaggtgcgaaagcgtggggagcaaacagg

SEQ ID NO: 1612 - DNA, 253 bp, Unknown
  Description of Unknown: bacterium polynucleotide
  Deltaproteobacteria
tacgtagggtgcaagcgttgttcggaattattgggcgtaaagcgcgcgtaggcgggtttgtaagtcgattgtgaaagccctgggcttaacctgggaatggcagtcgaaactgcaaatcttgaatgtctgagaggatggcggaattcccggtgtagtagtgaaatacgtagatatcgggaggaacacctgaggcgaaggcggctatctggcggtacattgacgctgaggcgcgaaagcgtggggagcaaacagg

SEQ ID NO: 1613 - DNA, 253 bp, Unknown
  Description of Unknown: bacterium polynucleotide
  Deltaproteobacteria
tacggagggtgcaagcgttgctcggaattattgggcgtaaagggcaggtaggtggtctcgtttgtctagggtgaaagccttgagcttaactcaagaagtgccctagaaacggcgagactagagttctggagagggtcgtggaattcccggtgtagcggtgaaatgcgtagagatcgggaggaacaccagaggcgaaagcggcgacctggacagatactgacactcaactgcgaaagcgtggggatcaaacagg

SEQ ID NO: 1614 - DNA, 253 bp, Unknown
  Description of Unknown: bacterium polynucleotide
  Deltaproteobacteria
gacagagggtgcaaacgttgctcggaatcactgggcgtaaagggcgtgtaggcgggaaggtaagtcgggcgtgaaatccctgggctcaacccaggaactgcactcgaaactacttttcttgagtgccggagaggaaagcggaattcctggtgtagaggtgaaattcgtagatatcaggaggaacaccagtggcgaaggcggctttctggacggtaactgacgctgagacgcgaaagcgtggggagcaaacggg

SEQ ID NO: 1615 - DNA, 253 bp, Unknown
  Description of Unknown: bacterium polynucleotide
  Deltaproteobacteria
tacagagggtgcaaacgttgctcggaatcattgggcgtaaagcgcacgtaggcggcctagcaagtagggagtgaaagccctcggcttaaccgaggaagtgctttctaaactactaggcttgaatactggagagggtcgcggaattcccggtgtagaggtgaaattcgtagatatcgggaggaacaccagtggcgaaggcggcgacctggacagatattgacgctgaggtgcgaaagcgtggggagcaaacagg

SEQ ID NO: 1616 - DNA, 253 bp, Unknown
  Description of Unknown: bacterium polynucleotide
  Deltaproteobacteria
gacagagggtgcaaacgttgctcggatttactgggcgtaaagcgcatgtaggcgggcgattaagtcgggtgtgaaatccctgggctcaacctaggaactgcatccgaaactgatcaccttgagtagtggagaggaaagcggaattccgggtgtagaggtgaaattcgtagatatccggaggaacaccagtggcgaaggcggctttctggacactaactgacgctgagatgcgaaagcgtggggagcaaacagg

SEQ ID NO: 1617 - DNA, 253 bp, Unknown
  Description of Unknown: bacterium polynucleotide
  Deltaproteobacteria
gacagagggtgcaaacgttgttcggaattactgggcgtaaagcgagtgtaggcggttcgataagtcggatgtgaaagccccgggctcaacccgggaagtgcactcgatactgtcgagctagagtatcggagaggttggtggaattctcggtgtagaggtgaaattcgtagacatcgagaggagcaccggtggcgaaggcggccaactggacgaatactgacgctgagactcgaaagcgtggggagcaaacagg

SEQ ID NO: 1618 - DNA, 253 bp, Unknown
  Description of Unknown: bacterium polynucleotide
  Deltaproteobacteria
tacagggggtgcaaacgttgctcggaattattgggcgtaaagcgcacgtaggcggtctgttatgtcggatgtgaaagcccttggctcaactgaggaagtgcatccgaaactggcaggctagagtacgtaagagggtcgcggaattcccggtgtagaggtgaaattcgtagatatcgggaggaacaccggtggcgaaggcggcgacctgggacgatactgacgctgaggtgcgaaagcgtggggagcaaacaag

SEQ ID NO: 1619 - DNA, 253 bp, Unknown
  Description of Unknown: bacterium polynucleotide
  Deltaproteobacteria
gacagagggtgcaaacgttgttcggaattactgggcgtaaagcgtgtgtaggctgccgcgcaagtcggatgtgaaagccccgggctcaacctgggaagtgcactcgatactgcgcggctggagtcccggagaggttggtggaattctcggtgtagaggtgaaattcgtagatatcgagaggaacaccggtggcgaaggcggccaactggacggagactgacgctgagacacgaaagcgtggggaggaaacagg

SEQ ID NO: 1620 - DNA, 253 bp, Unknown
  Description of Unknown: bacterium polynucleotide
  Deltaproteobacteria
tacgtagggtgcaagcgttgtccggaattattgggcgtaaagcgcgtgtaggcggcttggcaagtcgggtgtgaaatccctcagctcaactgaggaagtgcgcccgaaactgcttggcttgagtaccggagaggatggtggaattcccgaagtagaggtgaaattcgtagatatcgggaggaacaccggtggcgaaggcgaccatctggacggatactgacgctgagacgcgaaagcgtgggtagcaaacagg

SEQ ID NO: 1621 - DNA, 253 bp, Unknown
  Description of Unknown: bacterium polynucleotide
  Deltaproteobacteria
tacggagggtgcaagcgttaatcggaattactgggcgtaaagcgcgcgtaggcggcagtgcaagtcggatgtgaaatcccgcggctcaaccgtggaagtgcacccgaaactgcacagctcgagtgtcggagaggaaggtggaatgcttggtgtagaggtgaaattcgtagatatcaagcggaacaccggtggcgaaggcggccttctggacgacgactgacgctgagacgcgaaagcgtgggtagcaaacagg

SEQ ID NO: 1622 - DNA, 253 bp, Unknown
  Description of Unknown: bacterium polynucleotide
  Deltaproteobacteria
tacagagggtgcaaacgttgttcggaattactgggcgtaaagcgtgtgtaggcggctacataagtcggatgtgaaagccccgggctcaacccgggaagtgcactcgatactgcgtagcttgagtctcggagaggttggtggaattctcggtgtagaggtgaaattcgcagatatcgagaggaacaccggtggcgaaggcggccaactggacgaagactgacgctgagacacgaaagcgtggggagcaaacagg

SEQ ID NO: 1623 - DNA, 253 bp, Unknown
  Description of Unknown: bacterium polynucleotide
  Deltaproteobacteria
gacagagggtgcaaacgttgctcggaatcattgggcgtaaagcgcgtgtaggcggcttgttacgtcgggtgtgaaagcccagggctcaaccctggcagtgcacccgaaacggggaagctggagtactggagaggcgagtggaattcctggtgtagaggtgaaattcgtagatatcaggaggaacaccggtgtcgaaggcggctcgctggccagtaactgacgctgagacgcgaaagcgtggggagcaaacaag

SEQ ID NO: 1624 - DNA, 253 bp, Unknown
  Description of Unknown: bacterium polynucleotide
  Deltaproteobacteria
tacagagggtgcaagcgttgttcggatttactgggcgtaaagcgcgcgtaggcggtatgtcaagtcggatgtgaaaacccaaggcttaaccatggaagtgcattcgaaactgacaaactagagtctcggagagggtggtggaattcctggtgtagaggtgaaattcgtaggtatcaggaagaacatcagtggcgaaggcgaccacctggacgaagactgacgctgaggtgcgaaagcgtggggatcaaacagg

SEQ ID NO: 1625 - DNA, 253 bp, Unknown
  Description of Unknown: bacterium polynucleotide
  Deltaproteobacteria
tacagagggtgcaagcgttgttcggaattactgggcgtaaagcgcgtgtaggtggcgatgtaagtcgggtgtgaaatccctcagcttaactgaggaagtgcactcgatactgtgtcgcttgagtgttggaggggatggcggaattcccggtgtagaggtgaaattcgtagatatcgggaggaacacctgtggcgaaggcggccatctggacaactactgacactgaaacgcgaaagcgtgggtagcaaacagg

SEQ ID NO: 1626 - DNA, 253 bp, Unknown
  Description of Unknown: bacterium polynucleotide
  Deltaproteobacteria
tacagagggtgcaaacgttgctcggatttactgggcgtaaagcgcgtgtaggcgggttcgcaagtcggacgtgaaagccctgggctcaacccaggaactgcgttcgaaactgcggatctagagtagtggagaggaaagtagaattcccggtgtagaggtgaaattcgtagatatcgggaggaataccagtggcgaaggcggctttctggacacttactgacgctgagacgcgaaagcgtggggagcaaacagg

SEQ ID NO: 1627 - DNA, 253 bp, Unknown
  Description of Unknown: bacterium polynucleotide
  Deltaproteobacteria
gacagagggtgcgaacgttgctcggaattactgggcgtaaagcgcgtgtaggtgggtccgcaagtcgggcgtgaaatccctgggctcaacccgggaactgcgctcgaaactgcagatcttgagtgccggagagggtggcggaattcctggtgtagaggtgaaattcgtagatatcaggaggaacaccggtggcgaaggcggccacctggacggctactgacactgagacgcgaaagcgtggggagcaaacagg

SEQ ID NO: 1628 - DNA, 253 bp, Unknown
  Description of Unknown: bacterium polynucleotide
  Deltaproteobacteria
tacatggggtgcaaacgttgctcggaattattgggcgtaaagcgcacgtaggcggtccgttaagtcagatgtgaaagcccccggctcaaccggggaagtgcatctgaaactggcgggctagagtacgaaagagggtcgcggaattcccggtgtagaggtgaaattcgtagatatcgggaggaacaccggtggcgaaggcggcgacctgggtcgatactgacgctgaggtgcgaaagcgtggggagcaaacagg

SEQ ID NO: 1629 - DNA, 253 bp, Unknown
  Description of Unknown: bacterium polynucleotide
  Deltaproteobacteria
tacagagggtgcaaacgttgttcggaattactgggcgtaaagcgcgtgtaggcggccctgcaagtcgggtgtgaaatcccatggctcaaccacggaagtgcactcgaaactgcagggccggagtcctggagaggaaggtggaatgcttggtgtagaggtgaaattcgtagatatcaagcggaacaccggtggcgaaggcggccttctggacagtgactgacgctgagacgcgaaagcatggggagcaaacagg

SEQ ID NO: 1630 - DNA, 253 bp, Unknown
  Description of Unknown: bacterium polynucleotide
  Deltaproteobacteria
gacagagggtgcaaacgttgttcggatttactgggcgtaaagcgcgtgtaggcggctttgcaagtcggatgtgaaagcccacggctcaaccgtggaagtgcatccgaaactgcatggctcgagtctcggagaggaaggtggaatgcttggtgtagaggtgaaattcgtagatatcaagcagaacacctgcggcgaaggcggccttctggacgatgactgatgctgagacgcgaaagcgtggggagcaaacagg

SEQ ID NO: 1631 - DNA, 252 bp, Unknown
  Description of Unknown: bacterium polynucleotide
  Deltaproteobacteria; Entotheonellaceae
tacggaaggggcaagcgttgttcggaatcattgggcgtaaagggcgtgtaggcggtttcatgtgtccgctgtgaaacaacacggctcaaccgtgtagagcggcggaaactgtgagacttgaggctgggaggggctggtggaattccctgtgtagcggtgaaatgcgtagagatgggggagaacactcgtggcgaaggcggccagctggaccagttctgacgctgagacgcgaaagcgtggggagcaaacagg

SEQ ID NO: 1632 - DNA, 253 bp, Unknown
  Description of Unknown: bacterium polynucleotide
  Deltaproteobacteria; Entotheonellaceae
tacggagggggcgagcgttgttcggaatcattgggcgtaaagggcgcgtaggtggtgctgtatgtctcccgtgaaagcccacggctcaactgtggggcgtcgggagaaactgcaggacttgaggctgggaggggctggtggaattccctgtgtagcggtgaaatgcgtagagatgggggagaacactcgtggcgaaggcggccagctagaccagttctgacactgaggcgcgatagcgtggggagcaaacagg

SEQ ID NO: 1633 - DNA, 253 bp, Unknown
  Description of Unknown: bacterium polynucleotide
  Deltaproteobacteria; Entotheonellaceae
tacggaaggggcaagcgttgttcggaatcattgggcgtaaagggcgcgtaggcggttgtgtttgtccgctgtgaaagtccacggctcacccgtggagggtcggtggaaacggcacaacttgaggctgggaggggttggtggaattccctgtgtagcggtgaaatgcgtagatacgggggagaacactcgtggcgaaggcggccagctggcccagtcctgacgctgaggcgcgacagcgtggggagcaaacagg

SEQ ID NO: 1634 - DNA, 253 bp, Unknown
  Description of Unknown: bacterium polynucleotide
  Deltaproteobacteria; Entotheonellaceae
tacggaaggggcaagcgttgttcggaatcattgggcgtaaagggcgcgtaggtggttctgtgtgtctactgtgaaagcgtacagctcaactgtattttgtcggtagaaactgcagggcttgaggctgggaggggctggtggaattccctgtgtagcggtgaaatgcgtagagatgggggagaacactcgtggcgaaggcggccagctagaccagttctgacactgaggcgcgacagcgtggggagcaaacagg

SEQ ID NO: 1635 - DNA, 253 bp, Unknown
  Description of Unknown: bacterium polynucleotide
  Deltaproteobacteria; 0319-6G20
tacagagggtgcaagcgttgttcggaattactgggcgtaaagcgtgcgtagtcggtattgagagtcacgggtgaaatcccaaggcttaaccttggaactgcctgtgagacctcagtactagagtgtgagaggggatagtggaatacccagtgtagcggtgaaatgcgtagagattgggtggaacaccggtggcgaaggcggctatctggctcacaactgacgatcaggcacgaaagcgtggggagcaaacagg

SEQ ID NO: 1636 - DNA, 253 bp, Unknown
  Description of Unknown: bacterium polynucleotide
  Deltaproteobacteria; Bacteriovoracaceae
tacgaggggtgcaagcgttgttcggatttattgggcgtaaagcgcgcgtaggcggacctgcaagtcagatgtgaaatctcggggctcaacctcgaaactgcgtctgaaactacaggtctagaatcttggagggggaaggggaatttctcatgtaggggtaaaatccgtagatatgagaaggaacaccagaggcgaaggcgccttcctggacaagtattgacgctgaggcgcgaaagcgtggggatcaaacagg

SEQ ID NO: 1637 - DNA, 253 bp, Unknown
  Description of Unknown: bacterium polynucleotide
  Deltaproteobacteria; Bacteriovoracaceae
tacgaagggtccaagcgttgttcggaatcattgggcgtaaagcgcgcgcaggcggatttgtaagtcagatgtgaaatctcgaggctcaacctcgaaactgcgtctgaaactacaagtctagagtgtcggagggggtaggggaatttcacgtgtaggggtaaaatccgtagagatgtggaggaacaccggtggcgaaggcgcctacctggacgactactgacgctgaggcgcgaaagcgtggggagcaaacagg

SEQ ID NO: 1638 - DNA, 253 bp, Unknown
  Description of Unknown: bacterium polynucleotide
  Deltaproteobacteria; Bacteriovoracaceae
tacgaagggtgcaagcgttattcggaatcattgggcgtaaagcgcgcgcaggcggatttgtaagtcaggtgtgaaatctcggggctcaaccccgaaactgcgcctgaaactacaagtctagaatgtcggagggggcaggggaatttcacgtgtaggggtaaaatccgtagagatgtgaaggaacaccggaggcgaaggcgcctgcctggacgactattgacgctgaggcgcgaaagcgtggggagcaaacagg

SEQ ID NO: 1639 - DNA, 253 bp, Unknown
  Description of Unknown: bacterium polynucleotide
  Deltaproteobacteria; Bacteriovoracaceae
tacgaagggtgcaagcgttgttcggatttattgggcgtaaagcgcgcgtaggcggacctgcaagtcagatgtgaaatctcgaggctcaacctcgaaactgcgtctgaaactacaggtctagaatctcggagggggaaggggaatatcgcatgtaggggtaaaatccgtagatatgcgatggaacaccagaggcgaaggcgccttcctggacgagtattgacgctgaggcgcgaaagcgtggggatcaaacagg

SEQ ID NO: 1640 - DNA, 252 bp, Peredibacter starrii
  Deltaproteobacteria; Bacteriovoracaceae; Peredibacter starrii
tacgaagggtgcaagcgttgttcggaatcattgggcgtaaagcgcgcgcaggcggatcagtaagtcagatgtgaaatctcgaagctcaacttcgatactgcgtctgaaactactagtctagaatgtcggagggggcaggggaatttcacgtgtaggggtaaaatccgtagagatgtgaaggaacaccgggggcgaaggcgcctgcctggacgactattgacgctgaggcgcgaaagcgtgggagcaaacagg

SEQ ID NO: 1641 - DNA, 253 bp, Peredibacter starrii
  Deltaproteobacteria; Bacteriovoracaceae; Peredibacter starrii
tacgaagggtgcaagcgttattcggaatcattgggcgtaaagcgcgcgcaggcggatcagcaagtcagatgtgaaatctcggagctcaactccgaaactgcgtctgaaactgctagtctagagtgtcggagggggtaggggaatttcacgtgtaggggtaaaatccgtagagatgtgaaggaacaccgggggcgaaggcgcctacctggacgactactgacgctgaggcgcgaaagcgtggggagcgaacagg

SEQ ID NO: 1642 - DNA, 253 bp, Peredibacter starrii
  Deltaproteobacteria; Bacteriovoracaceae; Peredibacter starrii
tacgaagggtccaagcgttgttcagaatcattgggcgtaaagcgcgcgcaggcggatcagtaagtcagatgtgaaatctcagggctcaaccctgaaactgcgtctgaaactactagtctagagtgtcggagggggtaggggaatttcacgtgtaggggtaaaatccgtagagatgtgaaggaacaccggaggcgaaggcgcctgcctggacgactactgacgctgaggcgcgaaagcgtggggagcaaacagg

SEQ ID NO: 1643 - DNA, 253 bp, Bdellovibrio sp.
  Deltaproteobacteria; Bdellovibrionaceae; Bdellovibrio
tacgaggggtccaagcgttgttcggaatcattgggcgtaaagcgggtgtaggtggctctgtaagtcaggagtgaaagccccaggctcaacctgggaagtgcttttgatactgcagagcttgagtgtaggagaggatcgtggaattccaggtgtagtggtgaaatacgtagatatctggaggaacaccggtggcgaaggcggcgatctggcctaacactgacactcagacccgaaagtgcggggatcaaacaag

SEQ ID NO: 1644 - DNA, 253 bp, Bdellovibrio sp.
  Deltaproteobacteria; Bdellovibrionaceae; Bdellovibrio
gacgagggatcctagcgttgttcggaatcattgggcgtaaagcgggcgtaggtggctatttaagtcagttgtgaaagcctggggcttaacctcagaagtgcaattgatactatttagcttgagtgtgggaaaggtaactagaattcctggtgtagtggtgaaatacgtagatatcaggaggaatgccggttgcgaaggcgggttactagcccaacactgacactgaggcccgaaagcgtggggatcaaacagg

SEQ ID NO: 1645 - DNA, 253 bp, Bdellovibrio sp.
  Deltaproteobacteria; Bdellovibrionaceae; Bdellovibrio
gacggggggtccaagcgttgttcggaatcattgggcgtaaagcgtgtgcaggtggtcttgtaagttggatgtgaaagccccgggcttaacccgggaagtgcattcaaaactgcaagacttgagtatggaagagggtcgtggaattccaggtgtagtggtgaaatacgtagatatctggaggaacaccggtggcgaaggcggcgacctggtcctatactgacactcatacacgaaagcgtgggtagcaaacagg

SEQ ID NO: 1646 - DNA, 253 bp, Bdellovibrio sp.
  Deltaproteobacteria; Bdellovibrionaceae; Bdellovibrio
tacgtagggcgcaagcgttatccggaatcattgggcgtaaagggtgtgtaggtggctatgtaagtcaggtgtgaaagccccgggctcaacccgggaagtgcatctgatactgcgtagcttgagtaccgaagaggatagtggaattccaggtgtagtggtgaaatacgtagatatctggaggaacaccggtggcgaaggcggctatctggtcgagtactgacactgagacacgaaagcatggggatcaaacagg

SEQ ID NO: 1647 - DNA, 253 bp, Bdellovibrio bacteriovorus
  Deltaproteobacteria; Bdellovibrionaceae; Bdellovibrio bacteriovorus
gacgagggatcctagcgttgttcggaattattgggcgtaaagcgggtgtaggtggctatgtaagtcaagtgtgaaagcctggggctcaaccccagaagtgcatttgatactgcgtagcttgagtgctggagaggatagtagaattgttggtgtagtggtgaaatacgtagatatcaacaggaataccggtggcgaaggcggctatctggccaagcactgacactcagacccgaaagcgtggggatcaaacagg

SEQ ID NO: 1648 - DNA, 253 bp, Bdellovibrio bacteriovorus
  Deltaproteobacteria; Bdellovibrionaceae; Bdellovibrio bacteriovorus
gacgagggatcctagcgttgttcggaatcattgggcgtaaagcgggtgtaggtggctatgtaagtcgagtgtgaaagcctggggctcaaccccagaagtgcattcgatactgcgtagcttgagtggtagagaggatagtagaattgttggtgtagtggtgaaatacgtagatatcaacaggaataccggtggcgaaggcggctatctggctacacactgacactcagacccgaaagtgcggggatcaaacagg

SEQ ID NO: 1649 - DNA, 253 bp, Bdellovibrio sp.
  Deltaproteobacteria; Bdellovibrionaceae; Bdellovibrio
gacgaggggtcctagcgttgttcggaatcactgggcgtaaagagttcgtaggcggcttcgtaagtcgggtgtgaaatcccacggctcaaccgtggaagtgcattcgaaactgcaaagcttgaatatggaagaggagagtagaattgctggtgtagtggtgaaatacgtagatatcagcaggaataccggtggcgaaggcggctctctggtccaatattgacgctgaggaacgaaagtgcggggatcaaacagg

SEQ ID NO: 1650 - DNA, 253 bp, Bdellovibrio sp.
  Deltaproteobacteria; Bdellovibrionaceae; Bdellovibrio
gacgaggggtccaagcgttgttcggaatcattgggcgtaaagcgggtgtaggtggctctataagtcaggagtgaaagccccgagcttaacttagaaagtgcttttgatactgtagagcttgaatgtgggagaggatcgtggaattccaggtgtagtggtgatatacgtagatatctgggggaacaccggtggcgaaggcggcgatctggcccaacattgacactgagacccgaaagcatggggatcaaacagg

SEQ ID NO: 1651 - DNA, 253 bp, Bdellovibrio sp.
  Deltaproteobacteria; Bdellovibrionaceae; Bdellovibrio
gacgagggatcctagcgttgttcggaattattgggcgtaaagcggatgtaggtggctttgtaagtcaggtgtgaaagcctagggctcaaccctagaagtgcatctgatactgcgaagcttgagtgtgggagaggatagtagaattcctggtgtagtggtgaaatacgtagatatcaggaggaataccggaggcgaaggcggctatctggcccaacactgacactgagatccgaaagcgtggggatcaaacagg

SEQ ID NO: 1652 - DNA, 253 bp, Bdellovibrio sp.
  Deltaproteobacteria; Bdellovibrionaceae; Bdellovibrio
gacgaggggtccaagcgttgttcggaattattgggcgtaaagcgggtgtaggtggctttgtaagtcagaagtgaaatccccgagcttaacttgggaagtgcttttgaaactgcaaagcttgaatgtgggagaggatcgtggaattccaggtgtagtggtgaaatacgtagatatctggaggaacaccggtggcgaaggcggcgatctggcccaacattgacactgagacccgaaagcgtggggatcaaacagg

SEQ ID NO: 1653 - DNA, 253 bp, Bdellovibrio sp.
  Deltaproteobacteria; Bdellovibrionaceae; Bdellovibrio
gacgaggggtccaagcgttgttcggaattattgggcgtaaagcgggtgtaggtggctttgtaagtcaggagtgaaagccctaggctcaacctaggaagtgcttttgatactgcaaagcttgagtgtgggagaggatgctggaattccaggtgtagtggtgaaatacgtagatatctggaggaacaccggtggcgaaggcgggcatctggcccaacactgacactcagacccgaaagcatggggatcaaacagg

SEQ ID NO: 1654 - DNA, 253 bp, Bdellovibrio sp.
  Deltaproteobacteria; Bdellovibrionaceae; Bdellovibrio
gacgaggggtccaagcgttgttcggaattattgggcgtaaagcgggtgtaggtggctctctaagtcagaagtgaaagccccaggcttaacctgggaagtgcttttgatactggagagcttgaatgtgggagaggatcgtggaattccaggtgtagtggtgaaatacgtagatatctggaggaacaccggtggcgaaggcggcgatctggcccaacattgacactgagacccgaaagcgtggggatcaaacagg

SEQ ID NO: 1655 - DNA, 253 bp, Bdellovibrio sp.
  Deltaproteobacteria; Bdellovibrionaceae; Bdellovibrio
gacgaggggtccaagcgttgttcggaattattgggcgtaaagcgggtgtaggtggatctataagtcaggagtgaaagccccgagcttaacttgggaagtgcttttgatactgtagatcttgaatgtgggagaggatcgtggaattccaggtgtagtggtgaaatacgtagatatctggaggaacaccggtggcgaaggcggcgatctggcccaacattgacactgagacccgaaagtgcggggatcaaacagg

SEQ ID NO: 1656 - DNA, 253 bp, Bdellovibrio sp.
  Deltaproteobacteria; Bdellovibrionaceae; Bdellovibrio
gacgaggggtccaagcgttgttcggaatcattgggcgtaaagcgggtgtaggtggctctgtaagtcaggagtgaaagccccgagcttaacttgggaagtgcttttgatactgcagaacttgaatgtgggagaggatcgtggaactcctggtgtagtggtgaaatacgtagatatcaggaggaacaccggtggcgaaggcggcgatctggcccaacattgacactgagacccaaaagcgtggggatcaaacagg

SEQ ID NO: 1657 - DNA, 253 bp, Bdellovibrio sp.
  Deltaproteobacteria; Bdellovibrionaceae; Bdellovibrio
gacgaggggtccaagcgttgttcggaattattgggcgtaaagcgggtgtaggtggctctataagtcaggagtgaaatccccgagcttaacttgggaagtgcttttgatactgcagagcttgagtgtgggagaggatcgtggaattccaggtgtagtggtgaaatacgtagatatctggaggaacaccggaggcgaaggcggcgatctggcccaacactgacactgagacccgaaagcgtggggatcaaacagg

SEQ ID NO: 1658 - DNA, 253 bp, Bdellovibrio sp.
  Deltaproteobacteria; Bdellovibrionaceae; Bdellovibrio
tacggggggtccaagcgttgttcggaatcactgggcgtaaagcgcatgtaggtggcttttcaagtcaactgtgaaagcccagggcctaaccctggaagtgcagttgatactgctaagcttgagtacgagagaggatagtggaattcctggtgtagtggtgaaatacgtagatatcaggaggaacatcggtggcgaaggcggctatctggctcgatactgacactgagatgcgaaagcgtggggatcaaacagg

SEQ ID NO: 1659 - DNA, 253 bp, Bdellovibrio sp.
  Deltaproteobacteria; Bdellovibrionaceae; Bdellovibrio
tacgaggggtccaagcgttgttcggaatcactgggcgtaaagcgggtgtaggtggctctgcaagtcacatgtgaaagtcccgggctcaacccgggaagtgcatgtgatactacagagcttgagtaagggagaggatggcagaattccaggtgtagtggtgaaatacgtagatatctggaggaactccggtggcgaaggcggccatctggcccattactgacactcagacccgaaagcgtgggtagcaaacagg

SEQ ID NO: 1660 - DNA, 253 bp, Bdellovibrio sp.
  Deltaproteobacteria; Bdellovibrionaceae; Bdellovibrio
tacgagggatcctagcgttgttcggaatcattgggcgtaaagggtgtgtaggcggcctagtaagtcagttgtgaaagccccgggctcaacccgggaagtgcttctgatactgcttggcttgagtattggataggtgagtggaattccaggtgtagtggtgaaatacgtagatatctggaggaacaccggcggcgaaggcggctcactggccatatactgacgctgaaacacgaaagcgtgggtagcaaacagg

SEQ ID NO: 1661 - DNA, 253 bp, Unknown
  Description of Unknown: bacterium polynucleotide
  Deltaproteobacteria; Cystobacteraceae
tacagagggtgcaagcgttgttcggaattattgggcgtaaagcgcgtgtaggcggctttgcaagtcgggtgtgaaagccctcggctcaaccgaggaagtgcgcccgaaactgcagagcttgagtaccggagaggatggcggaattccccaagtagaggtgaaatacgtagatatggggaggaacaccggtggcgaaggcggccatctggacggatactgacgctgagacgcgaaagcgtggggagcaaacagg

SEQ ID NO: 1662 - DNA, 254 bp, Unknown
  Description of Unknown: bacterium polynucleotide
  Deltaproteobacteria; Cystobacterineae
gacagagggtgcaagcgttgttcggaattattgggcgtaaagggcgcgtaggcggtcttgcaagtcggatgtgaaagcccagggctcaaccttggacgtgcatccgaaactgtaagactagagttcacggagagggtggtggaattcccagtgtagaggtgaaattcgtagatattgggaggaacaccagtggcgaaggcgaccacctggacggaaactgacgctgaggcgcgagagcgtgggtagcaaacagg

SEQ ID NO: 1663 - DNA, 253 bp, Unknown
  Description of Unknown: bacterium polynucleotide
  Deltaproteobacteria; Cystobacterineae
tacggagggtgcaagcgttaatcggaattactgggcgtaaagcgcacgtaggcggtctgttaagtcgggtgtgaaatcccggggctcaaccccggaagtgcattcgaaactagcagacttgagtcccggagagggtggcggaattcctggtgtagaggtgaaattcgtagatatcaggaggaacatccgtggcgaaggcggccatctggacggtgactgacgctgaggtgcgaaagcgtggggagcaaacagg

SEQ ID NO: 1664 - DNA, 253 bp, Unknown
  Description of Unknown: bacterium polynucleotide
  Deltaproteobacteria; Cystobacterineae
gacagagggtgcaagcgttgttcggaattattgggcgtaaagggcgcgtaggtggccgcgtaagtcggatgtgaaagcccagggcttaaccctggaagtgcatccgatactgtgtggcttgagtcccggagagggtcgtggaattcccagtgtagaggtgaaattcgtagatattgggaggaacaccagtggcgaaggcgacgacctggacgaggactgacactgaggcgcgaaagcgtggggagcaaacagg

SEQ ID NO: 1665 - DNA, 253 bp, Unknown
  Description of Unknown: bacterium polynucleotide
  Deltaproteobacteria; Cystobacterineae
tacagagggtgcaagcgttgttcggaatcattgggcgtaaagcgcacgtaggcggcttactaagtcggatgtgaaagccccaggctcaacctgggaagtgcattcgaaactggtgagcttgaatgtcggagagggcagtggaattccgagtgtagaggtgaaattcgtagatattcggaggaacaccagtggcgaaggcgactgcctggacgaacattgacgctgaggtgcgaaagcgtggggagcaaacagg

SEQ ID NO: 1666 - DNA, 253 bp, Unknown
  Description of Unknown: bacterium polynucleotide
  Deltaproteobacteria; Desulfobacteraceae
tacggagggtgcgagcgttattcggatttattgggcgtaaagggcgcgtaggcggctgattaagtcagatgtgaaaacccaaagcttaactttggaagtgcatttgaaactgatcagcttgagtatgggagagggaagcggaattcctggtgtagaggtgaaattcgtagagatcaggaggaacaccggtggcgaaggcggcttcctggatcaatactgacgctgaggcgcgaaggcgtggggagcaaacagg

SEQ ID NO: 1667 - DNA, 253 bp, Desulfobulbus sp.
  Deltaproteobacteria; Desulfobulbaceae; Desulfobulbus
cacggggggagcaagcgttgttcggaatcactgggcgtaaagggcgcgtaggcggtttgataagtcagatgtgaaagcccacggcttaaccgtggaagtgcatttgaaactgtcagacttgagtaccagaggggaaagtggaattcccggtgtagaggtgaaattcgtagatatcgggaggaataccggtggcgaaggcgactttctggctggatactgacgctgaggcgcgaaagcgtggggagcaaacagg

SEQ ID NO: 1668 - DNA, 253 bp, Geobacter sp.
  Deltaproteobacteria; Geobacteraceae; Geobacter
tacggagggtgcaagcgttgttcggatttattgggcgtaaagcgcgtgtaggcggtttcttaagtctggtgtgaaagccctgggctcaacccaggaagtgcattggatactgggagacttgaatacgggagagggtagtggaattcctagtgtaggagtgaaatccgtagatattaggaggaacaccggtggcgtaggcggctacctggaccgatattgacgctgagacgcgaaagcgtggggagcaaacagg

SEQ ID NO: 1669 - DNA, 253 bp, Geobacter sp.
  Deltaproteobacteria; Geobacteraceae; Geobacter
tacagagggtgcaagcgttgttcggaattattgggcgtaaagcgcgtgtaggcggtttgttaagtctgatgtgaaagccccgggctcaacctgggaagtgcattggatactgtcagacttgaatacgggagagggtagtggaattcctagtgtaggagtgaaatccgtagatattaggaggaacaccggtggcgaaggcggctacctggaccgatattgacgctgagacgcgaaagcgtgggtagcaaacagg

SEQ ID NO: 1670 - DNA, 253 bp, Geobacter sp.
  Deltaproteobacteria; Geobacteraceae; Geobacter
tacggagggtgcgagcgttgttcggaattattgggcgtaaagcgcgtgtaggcggttttttaagtctgatgtgaaagccccgggctcaacctgggaagtgcattggatactggaagacttgagtacgggagagggtagtggaattcctagtgtaggagtgaaatccgtagatattaggaggaacaccggtggcgaaggcggctgcctggaccgatactgacgctgagacgcgaaagcgtggggagcaaacagg

SEQ ID NO: 1671 - DNA, 253 bp, Unknown
  Description of Unknown: bacterium polynucleotide
  Deltaproteobacteria; Haliangiaceae
tacgaagggtgcgaacgttgctcggaattattgggcgtaaagcgcacgtaggcggcttggcaagtcggatgtgaaatccctcggctcaaccaaggaagtgcatccgaaactgccgagcttgagtacttaagaggatcgcggaattcccggtgtagaggtgaaattcgtagatatcgggaggaacaccagtggcgaaggcggcgatctgggaagatactgacgctgaggtgcgaaagcgtggggagcaaacagg

SEQ ID NO: 1672 - DNA, 253 bp, Unknown
  Description of Unknown: bacterium polynucleotide
  Deltaproteobacteria; Haliangiaceae
tacgaagggtgcaaacgttgctcggaatcattgggcgtaaagcgcacgtaggcggcttcgcaagtcggatgtgaaatccctcggctcaaccgaggacgtgcatccgaaactgcggagcttgagtatggaagagggtcgcggaattcccggtgtagaggtgaaattcgtagatatcgggaggaacaccagtggcgaaggcggcgacctgggccaatactgacgctgaggtgcgaaagcgtggggagcaaacagg

SEQ ID NO: 1673 - DNA, 253 bp, Unknown
  Description of Unknown: bacterium polynucleotide
  Deltaproteobacteria; Haliangiaceae
tacgaagggtgcaaacgttgcccggaatcattgggcgtaaagcgcacgtaggcggctccaaaagtcgcatgtgaaatccctcggctcaaccgaggacgtgcatccgaaactgcggagcttgagtatggaagagggtcgcggagtccccggtgtagaggtgaaattcgtagatatcggggggaacaccagtggcgaaggcggcgacctgggccaatactgacgctgaggtgcgaaagcgtggggagcaaacagg

SEQ ID NO: 1674 - DNA, 253 bp, Unknown
  Description of Unknown: bacterium polynucleotide
  Deltaproteobacteria; Haliangiaceae
tacgaagggtgcaaacgttgctcggaattattgggcgtaaagcgcacgtaggcggcttagcaagtcggatgtgaaatccctcggctcaaccaaggaagtgcatccgaaactgctgagcttgagtacgaaagaggatcgcggaattcccggtgtagaggtgaaattcgtagatatcgggaggagcaccagtggcgaaggcggcgatctgggtcgatactgacgctgaggtgcgaaagcgtggggagcaaacagg

SEQ ID NO: 1675 - DNA, 253 bp, Unknown
  Description of Unknown: bacterium polynucleotide
  Deltaproteobacteria; Haliangiaceae
tacgaagggtgcaaacgttgctcggaattattgggcgtaaagcgcacgtaggcggctttgtaagtcggatgtgaaatccctcggcttaaccaaggaagtgcatccgaaactacagagcttgagtacttaagaggatcgcggaattcccggtgtagaggtgaaattcgtagatattcggaagaacaccagtggcgaaggcgacatactgggtcatgactgacgctgaggctcgaaggcgtggggagcaaacagg

SEQ ID NO: 1676 - DNA, 253 bp, Unknown
  Description of Unknown: bacterium polynucleotide
  Deltaproteobacteria; Haliangiaceae
tacgaagggtgcaaacgttgctcggagtcattgggcgtaaagcgcacgtaggcggccttgcaagtcggatgtgaaatccctcggctcaaccgaggacgtgcatccgaaactgctcggctcgagtatggaagagggtcgcagaattcccggtgtagaggtgaaattcgtagatatcgggaggaataccagtggcgaaggcggcgacctgggccaatactgacgctgaggtgcgaaagcgtggggagcaaacagg

SEQ ID NO: 1677 - DNA, 253 bp, Unknown
  Description of Unknown: bacterium polynucleotide
  Deltaproteobacteria; Haliangiaceae
tacgtagggcgcaaacgttgctcggaattattgggcgtaaagcgcacgtaggcggcttcgcaagtcccatgtgaaagcccacggcttaaccgtggaagtgcatgggaaactgcagagcttgagtacttaagaggatcgcggaattcccggtgtagaggtgaaattcgtagatatcgggaggaacaccaggggcgaaggcggcgatctgggaagatactgacgctgaggtgcgaaagcgtggggagcaaacagg

SEQ ID NO: 1678 - DNA, 253 bp, Unknown
  Description of Unknown: bacterium polynucleotide
  Deltaproteobacteria; Haliangiaceae
tacgaagggtgcaaacgttgctcggaattattgggcgtaaagcgcacgtaggcggcttagcaagtcggaagtgaaatccctcggctcaaccaaggaagtgctttcgaaactgctgagcttgggtagttaagaggatcgcggaattcccggtgtagaggtgaaattcgtagatatcgggaggaacaccagtggcgaaggcggcgatctgggaacatactgacgctgaggtgcgaaagcgtggggagcaaacagg

SEQ ID NO: 1679 - DNA, 253 bp, Unknown
  Description of Unknown: bacterium polynucleotide
  Deltaproteobacteria; Haliangiaceae
tacgaagggtgcaaacgttgctcggaatcattgggcgtaaagcgcacgtaggcggcttcgcaagtcggatgtgaaatacctaggctcaaccaaggacgtgcatccgaaactgcgaggcttgagtacagaagaggatcgcggaattcccggtgtagaggtgaaattcgtagatatcgggaggaacaccagtggcgaaggcggcgatctgggctgatactgacgctgaggtgcgaaagcgtggggagcaaacagg

SEQ ID NO: 1680 - DNA, 253 bp, Unknown
  Description of Unknown: bacterium polynucleotide
  Deltaproteobacteria; Haliangiaceae
tacgtagggggcaagcgttgtccggattcattgggcgtaaagagctcgtaggcggcttggcgagtcggatgtgaaatccctcggctcaaccgaggacgtgcatccgaaactggaacgctcgagtatggaagagggtcgcggaattctcggtgtagaggtgaaattcgtggatatcgggaggaacaccagtggcgaaggcggcgacctgggccaatactgacgctgaggtgcgaaagcgtggggagcaaacagg

SEQ ID NO: 1681 - DNA, 253 bp, Haliangium sp.
  Deltaproteobacteria; Haliangiaceae; Haliangium
tacggagggtgcaaacgttgctcggaatcactgggcgtaaagcgcacgtaggcggtccgataagtcggatgtgaaagccctgggctcaacctaggaagtgcattcgaaactgtcggacttgagtacgggagagggttgcggaattcccggtgtagaggtgaaattcgtagatatcgggaggaacaccagtggcgaaggcggcgacctgggccaatactgacgctgaggcacgaaagcgtggggagcgaacagg

SEQ ID NO: 1682 - DNA, 253 bp, Unknown
  Description of Unknown: bacterium polynucleotide
  Deltaproteobacteria; Myxococcaceae
tacagagggtgcgagcgttgttcggaattattgggcgtaaagcgctggtaggtggcttggaaagtcgcgtgtgaaagctcccggctcaaccgggaaagtgcgcgcgaaactgacgagcttgagtgccggagagggtcgcggaattcccggtgtagaggtgaaattcgtagatatcgggaggaacaccagaggcgaaggcggcgacctggaaggtgactgacactgagcagcgaaagcgtgggtagcaaacagg

SEQ ID NO: 1683 - DNA, 253 bp, Unknown
  Description of Unknown: bacterium polynucleotide
  Deltaproteobacteria; Myxococcaceae
tacagagggtgcgagcgttgttcggaattattgggcgtaaagcgcttgtaggcggcctgttaagttccgtgtgaaatcccctggcttaaccagggaagtgcgcggaaaactggcgggcttgagtgccggagagggtcgcggaattcccggtgtagaggtgaaattcgtagatatcgggaggaacaccagtggcgaaggcggcgacctggacggacactgacgctgagacgcgaaagcgtggggagcaaacagg

SEQ ID NO: 1684 - DNA, 253 bp, Corallococcus exiguus
  Deltaproteobacteria; Myxococcaceae; Corallococcus exiguus
tacagagggtgcaagcgttgttcggaattattgggcgtaaagagcgtgtaggcggccttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacagg

SEQ ID NO: 1685 - DNA, 253 bp, Nannocystis sp.
  Deltaproteobacteria; Nannocystaceae; Nannocystis
tacggagggtgcaaacgttgctcggaatcattgggcgtaaagcgcacgtaggcggcgaagcaagttgggtgtgaaagccctgggctcaacccaggaagtgcattcaaaactgcttcgcttgaatctcggagggggtcagagaattcccggtgtagaggtgaaattcgtagatatcgggaggaataccagtggcgaaggcgctgacctggacgaagattgacgctgaggtgcgaaagcgcggggagcaaacagg

SEQ ID NO: 1686 - DNA, 253 bp, Nannocystis sp.
  Deltaproteobacteria; Nannocystaceae; Nannocystis
tacggagggtgcaaacgttgctcggaatcattgggcgtaaagcgcacgtaggcggcgtgataagttgggtgtgaaagccctgggctcaacccaggaagtgcattcaaaactgtcacgcttgaatctcggaggggatcagagaattcccggtgtagaggtgaaattcgtagatatcgggaggaataccagtggcgaaggcgctgacctggacgaagattgacgctgaggtgcgaaagcgcggggagcaaacagg

SEQ ID NO: 1687 - DNA, 253 bp, Plesiocystis sp.
  Deltaproteobacteria; Nannocystaceae; Plesiocystis
tacggagggtgcaaacgttgctcggaatcactgggcgtaaagcgcacgtaggcggccttgtaagttggatgtgaaagccctgggctcaacccaggaagtgcatccaaaactgcatggcttgagtaccggaggggttcagagaattcctggtgtagaggtgaaattcgtagatatcaggaggaataccagtggcgaaggcgctgaactggacggtcactgacgctgaggtgcgaaagcgtgggtagcaaacagg

SEQ ID NO: 1688 - DNA, 253 bp, Plesiocystis sp.
  Deltaproteobacteria; Nannocystaceae; Plesiocystis
tacggagggtgcaaacgttgctcggaatcattgggcgtaaagcgcgcgtaggcggcgaggcaagttggatgtgaaagccctgggctcaacctaggatgtgcatacaaaactgcctcgcttgaatctcggagggggtcagggaattcccggtgtagaggtgaaattcgtagatatcgggaggaacaccagtggcgaaggcgctgacctggacgatgattgacgctgaggcgcgaaagcgtggggagcaaacagg

SEQ ID NO: 1689 - DNA, 253 bp, Plesiocystis sp.
  Deltaproteobacteria; Nannocystaceae; Plesiocystis
tacggagggtgcaaacgttgctcggaattattgggcgtaaagcgcacgtaggcggcctttcaagtcggatgtgaaagccctgggctcaacccaggaagtgcacccgaaactgattggcttgaatgccggaggggcccagagaattcccggtgtagaggtgaaattcgtagatatcgggaggaataccagtggcgaaggcgctgggctggacggtcattgacgctgaggtgcgaaagcgtggggagcaaacagg

SEQ ID NO: 1690 - DNA, 253 bp, Plesiocystis sp.
  Deltaproteobacteria; Nannocystaceae; Plesiocystis
tacggagggtgtaaacgttgctcggaatcattgggcgtaaagcgcacgtaggcggcctatcaagtcggatgtgaaagccctgggctcaaccccggaagtgcatccgaaactgacaggcttgaatgccggaggggcccagagaattcccggtgtagaggtgaaattcgtagatatcgggaggaataccagtggcgaaggcgctgggctggacggcgattgacgctgaggtgcgaaagcgtggggagcaaacagg

SEQ ID NO: 1691 - DNA, 253 bp, Plesiocystis sp.
  Deltaproteobacteria; Nannocystaceae; Plesiocystis
tacggagggtgcaaacgttgctcggaatcattgggcgtaaagcgcgcgtaggcggcttgacaagttggatgtgaaagccctgggctcgacccaggatgtgcattcaaaactgtcgagcttgaatctcggagggggtcagggaattcccggtgtagaggtgaaattcgtagatatcgggaggaacaccagtggcgaaggcgctgacctggacgatgattgacgctgaggcgcgaaagcgtggggatcaaacagg

SEQ ID NO: 1692 - DNA, 253 bp, Unknown
  Description of Unknown: bacterium polynucleotide
  Deltaproteobacteria; NB1-i
tacggagggtgcaagcgttgttcggaatcattgggcgtaaagcgcgtgtaggcggcttggcaagtcggttgtgaaagcccggggcccaaccccggaattgcatctgaaactgcctcgctagagtcccggagaggaaggcagaattcccggtgtaggggtgaaatccgtagatatcgggaggaataccagcggcgaaggcggccttctggacggtgactgacgctgagacgcgaaagcgtggggagcaaacagg

SEQ ID NO: 1693 - DNA, 253 bp, Unknown
  Description of Unknown: bacterium polynucleotide
  Deltaproteobacteria; OM27
tacggagggtgcgagcgttgctcggaattattgggcgtaaagcgtacgcaggcggctcggtaagtcgagtgtgaaatcccgaggctcaacctcggacgtgcattcgatactgtcgagcttgaatgcgggaaagggaagcggaattcctggtgtagaggtgaaattcgtagatatcaggaggaacaccggtggcgaaagcggcttcctggcccgacattgacgctcatgtacgaaagcgtggggagcaaacagg

SEQ ID NO: 1694 - DNA, 253 bp, Unknown
  Description of Unknown: bacterium polynucleotide
  Deltaproteobacteria; Polyangiaceae
gacagagggtgcaaacgttgttcggaattactgggcgtaaagcgcgtgtaggcggctcggaaagtcgggtgtgaaagccctgggctcaacctaggaagtgcactcgaaacttccgagctggagttctggagaggaaggcggaattctcggtgtagaggtgaaattcgtagatatcgagaggaacgccggtggcgaaggcggccttctggacagcaactgacgctgagacgcgaaagcgtggggagcaaacagg

SEQ ID NO: 1695 - DNA, 252 bp, Unknown
  Description of Unknown: bacterium polynucleotide
  Deltaproteobacteria; Polyangiaceae
gacagagggtgcaaacgttgttcggaattactgggcgtaaagcgcgtgtaggctgcttggcaagtcggatgtgaaagccctggctcaacccaggaagtgcattcgaaactgccgagctggagtcctggagaggaaggcggaattctcggtgtagaggtgaaattcgtagatatcgagaggaacaccggtggcgaaggcggccttctggacagtgactgacgctgagacgcgaaagcgtggggagcaaacagg

SEQ ID NO: 1696 - DNA, 253 bp, Unknown
  Description of Unknown: bacterium polynucleotide
  Deltaproteobacteria; Polyangiaceae
gacagagggtgcaaacgttgttcggaattactgggcgtaaagcgcgtgtaggctgctctgcaagtcggatgtgaaagccctgggctcaacctaggaagtgcactcgaaactgcagagcttgagtctcggagagggtcgcggaattctcggtgtagaggtgaaattcgtagatatcgagaggaacaccggtggcgaaggcggcgacctggacgatgactgacgctgagacgcgaaagcgtggggagcaaacagg

SEQ ID NO: 1697 - DNA, 254 bp, Unknown
  Description of Unknown: bacterium polynucleotide
  Deltaproteobacteria; Polyangiaceae
gacagagggtgcaaacgttgttcggaattactgggcgtaaagcgcgtgtaggcggcccggaaagtcggatgtgaaagccctgggcttaacctaggaagtgcattcgaaactcccgtggcttgagttctggagagggaagcggaattctcggtgtagaggtgaaattcgtagatatcgagaggaacaccggtggcgaaggcggcttcctggacagtgactgacgctgagacgcgaaagcgtggggagcaaacagg

SEQ ID NO: 1698 - DNA, 253 bp, Unknown
  Description of Unknown: bacterium polynucleotide
  Deltaproteobacteria; Polyangiaceae
gacagagggtgcaaacgttgttcggaattactgggcgtaaagcgcgtgtaggctgcttggaaagtcggatgtgaaagccctgggctcaacctaggaagtgcattcgaaacttccaggctcgagtttcggagaggaaggcggaattctcggtgtagaggtgaaattcgtagatatcgagaggaacatcggtggcgaaggcggccatctggaccagcactgacactgaggcacgaaagcgtggggagcaaacagg

SEQ ID NO: 1699 - DNA, 253 bp, Byssovorax cruenta
  Deltaproteobacteria; Polyangiaceae; Byssovorax cruenta
gacagagggtgcaaacgttgctcggaattactgggcgtaaagcgcgtgtaggcggctcggcaagtcggatgtgaaagccctgggcttaacctaggaagtgcattcgaaactgccaagcttgagttctggagaggaaggcggaattctcggtgtagcggtgaaatgcgcagatatcaggaggaacaccgatggcgaaggcagttctctgggccgtaactgacgctgaggagcgaaagcgtggggagcgaacagg

SEQ ID NO: 1700 - DNA, 253 bp, Chondromyces sp.
  Deltaproteobacteria; Polyangiaceae; Chondromyces
gacagagggtgcaaacgttgttcggaatgactgggcgtaaagcgcgtgtaggcggcctcgcaagtcgggtgtgaaagccctgggctcaacccaggaagtgcactcgaaactgcaaggcttgagttccggagaggaaagcggaattctcggtgtagaggtgaaattcgtagatatcgagaggaacaccggtggcgaaggcggctttctggacggcgactgacgctgagacgcgaaagcgtggggagcaaacagg

SEQ ID NO: 1701 - DNA, 253 bp, Sorangium cellulosum
  Deltaproteobacteria; Polyangiaceae; Sorangium cellulosum
gacagagggtgcaaacgttgttcggaattactgggcgtaaagcgcatgtaggcggttcgtaaagtcagatgtgaaagccctgggcttaacccaggaagtgcatttgaaactcacgaacttgagtcccggagaggaaggcggaattctcggtgtagaggtgaaattcgtagatatcgagaggaacatcggtggcgaaggcggccttctggacggtgactgacgctgagatgcgaaagcgtggggagcaaacagg

SEQ ID NO: 1702 - DNA, 253 bp, Unknown
  Description of Unknown: bacterium polynucleotide
  Deltaproteobacteria; Syntrophobacteraceae
gacggagggtgcaagcgttgttcggattgactgggcgtaaagggcgtgtaggcggttgcccaagtccgatgtgaaagcccgaggcctaccctcggaagtgcatcggaaactaggcagctggagcgcgatagaggagggtagaattcctggagtagcggtgaaatgcgtagatatcaggaggaataccggcggcgaaggcggccctctggatcgttgctgacgctgagacgcgaaagcgtggggagcaaacagg

SEQ ID NO: 1703 - DNA, 253 bp, Unknown
  Description of Unknown: bacterium polynucleotide
  Deltaproteobacteria; Syntrophobacteraceae
gacggaaggtgcaagcgttgctcggaatcactgggcgtaaagggtgcgtaggcggctgtgcaagtctggcgtgaaagccccgggctcagcccgggaagtgcgctcgaaactgcgcagctcgagtgccggaggggagagtggaattcctggtgtagcggtgaaatgcgtagatatcaggaggaataccggtggcgaaagcgactctctggacggtaactgacgctgaggcacgaaagcgtggggagcaaacagg

SEQ ID NO: 1704 - DNA, 253 bp, Unknown
  Description of Unknown: bacterium polynucleotide
  Deltaproteobacteria; Syntrophobacteraceae
tacgtagggggcaagcgttgttcggaattactgggcgtaaagggcgtgtaggcggtctgttaagtctgatgtgaaatcccctcgctcaacgagggaactgcgtcggatactggcagacttgagtaccggagaggaaggtggaattcccggtgtagcggtgaaatgcgtagatatcggggggaacaccggtggcgaaggcggccttctggacggatactgacgctgagacgcgaaagcgtggggagcaaacagg

SEQ ID NO: 1705 - DNA, 253 bp, Unknown
  Description of Unknown: bacterium polynucleotide
  Deltaproteobacteria; Syntrophobacteraceae
gacggagggtgcaagcgttgttcggattgactgggcgtaaagggcgtgtaggcggttcgttaagtcgggtgtgaaagcccggagctcagctccggaagtgcgtccgaaactggcgagctggagcgcggtagaggagggtggaattcctggtgtagcggtgaaatgcgtagatatcaggaggaacaccggcggcgaaggcggccctctggaccgttgctgacgctgagacgcgaaagcgtggggagcaaacagg

SEQ ID NO: 1706 - DNA, 253 bp, Unknown
  Description of Unknown: bacterium polynucleotide
  Deltaproteobacteria; Syntrophobacteraceae
gacggagggtgcaagcgttgttcggattgactgggcgtaaagggcgtgtaggcggttggtcaagtctggtgtgaaagcccggggcttagcctcggaagtgcatcggaaactagccagctggagtgcgatagaggagggtggaattcctggtgtagcggtgaaatgcgtagatatcaggaggaacaccggcggcgaaggcggccctctggatcgttactgacgctgagacgcgaaagcgtggggagcaaacagg

SEQ ID NO: 1707 - DNA, 253 bp, Unknown
  Description of Unknown: bacterium polynucleotide
  Deltaproteobacteria; Syntrophobacteraceae
tacagagggtgcgagcgttgttcggaatcattgggcgtaaagggcgtgtaggcggtttgctaagtcatgtgtgaaatccctcggctcaaccggggaaggacgcatgaaactgacaagctagagtaccaaagaggggggtggaattcccggtgtagcggtgaaatgcgtagatatcgggaggaacaccagtggcgaaggcggctctctggaccggtgctgacgctcaggcgcgaaagcgtggggagcgatccgg

SEQ ID NO: 1708 - DNA, 253 bp, Unknown
  Description of Unknown: bacterium polynucleotide
  Deltaproteobacteria; Syntrophobacteraceae
tacagagggtgcaagcgttgttcggaatcattgggcgtaaagggcgtgtaggcggtttgttaagtcatgtgtgaaatccctcggctcaaccggggaacgacgcatgaaactggcaagctagagtaccgaagaggggggtggaattcccggtgtagcggtgaaatgcgtagatatcgggaggaacacctgtggcgaaggcggccccctggtcggatactgacgctgatacgcgaaagcgtggggagcaaacagg

SEQ ID NO: 1709 - DNA, 253 bp, Unknown
  Description of Unknown: bacterium polynucleotide
  Deltaproteobacteria; Syntrophobacteraceae
gacggaaggtgcaagcgttgctcggaatcactgggcgtaaagggtgcgtaggcggccgcgcaagtctggcgtgaaagccccgggctcagcccgggaagggcgctcgaaacggcgcggctggagtgccggaggggagagtggaattcctggtgtagcggtgaaatgcgtagagatcaggaggaataccggtggcgaaagcgactctctggacggcaactgacgctgaggcacgaaagcgtggggagcaaacagg

SEQ ID NO: 1710 - DNA, 253 bp, Unknown
  Description of Unknown: bacterium polynucleotide
  Deltaproteobacteria; Syntrophobacteraceae
gacggagggtgcaagcgttgttcggattgactgggcgtaaagggcgtgtaggcggtcgatcaagtttgatgtgaaagcccggagctcagctccggaagtgcatcagaaactaaccggctggagcgcgatagaggagggcggaattcctggtgtagcggtgaaatgcgtagatatcaggaggaacaccggcggcgaaggcggccctctggatcgttgctgacgctgagacgcgaaagcgtggggagcaaacagg

SEQ ID NO: 1711 - DNA, 253 bp, Unknown
  Description of Unknown: bacterium polynucleotide
  Deltaproteobacteria; Syntrophobacteraceae
tacagagggtgcaagcgttgttcggaatcattgggcgtaaagggcgtgtaggcggtctgttaagtcatgtgtgaaatccctcggctcaaccggggaacgacgcatgaaactgacatgctagagtaccaaagaggggggtggaattcccggtgtagcggtgaaatgcgtagatatcgggaggaacaccggtggcgaaggcggccccctagttggatactgacgctgagacgcgaaagcgtggggagcaaacagg

SEQ ID NO: 1712 - DNA, 253 bp, Unknown
  Description of Unknown: bacterium polynucleotide
  Deltaproteobacteria; Syntrophobacteraceae
tacggagggtgctagcgttgttcggaatcactgggcgtaaagggcgtgtaggcggtctgttaagtctgatgtgaaatcccctcgcttaacgagggaactgcgtcggatactggcagacttgagtaccggagaggaaggtggaattcccggtgtagcggtgaaatgcgtagatatcgggaggaacaccggtggcgaaggcggccaactggacagatactgacgctaagacacgaaagcgtggggagcaaacagg

SEQ ID NO: 1713 - DNA, 253 bp, Unknown
  Description of Unknown: bacterium polynucleotide
  Deltaproteobacteria; Syntrophobacteraceae
tacagagggtgcaagcgttgttcggaattattgggcgtaaagggcgtgtaggcggtctgctaagtcatgtgtgaaatccctcggcttaaccgaggaacgacgcatgaaactggcaagctagagtaccaaagaggggggtggaattcccggtgtagcggtgaaatgcgtagatatcgggaggaacaccggtggcgaaggcggccccctggtcggatactgacgctgagacgcgaaagcgtggggagcaaacagg

SEQ ID NO: 1714 - DNA, 253 bp, Unknown
  Description of Unknown: bacterium polynucleotide
  Deltaproteobacteria; Syntrophobacteraceae
tacggagggtgcaagcgttgttcggaattactgggcgtaaagcgcgtgtaggcggccgattaagtctggtgtgaaagcccggggctcacccccggaagtgcgctggaaactggtcggctagagtatgggagaggaaagtggaattcccggtgtagcggtgaaatgcgtagatatcgggaggaacaccagcggcgaaggcggctttctggacgataactgacgctgtgacgcgaaagcgtggggagcaaacagg

SEQ ID NO: 1715 - DNA, 253 bp, Unknown
  Description of Unknown: bacterium polynucleotide
  Deltaproteobacteria; Syntrophobacteraceae
gacggagggtgcaagcgttgttcggaattactgggcgtaaagcgcgtgtaggcggctggctaagtctgatgtgaaagcccggggctcacccccggaagtgcattggaaactggccagctcgagtcccggagaggagggtggaattcctggtgtagcggtgaaatgcgtagatatcaggaggaacaccggtggcgaaggcggccctctggacggtgactgacgctgagacgcgaaagcgtggggagcaaacagg

SEQ ID NO: 1716 - DNA, 253 bp, Unknown
  Description of Unknown: bacterium polynucleotide
  Deltaproteobacteria; Syntrophobacteraceae
gacggagggtgcaagcgttgttcggattgactgggcgtaaagggcgtgtaggcggtttgtcaagtcgggtgtgaaagcctggggctcagccccagaagtgcatccgaaactagcgagctagagcgcgatagaggagggtggaattcctggtgtagcggtgaaatgcgtagatatcaggaggaacaccggcggcgaaggcggccctctggatcgttgctgacgctgagacgcgaaagcgtggggagcaaacagg

SEQ ID NO: 1717 - DNA, 253 bp, Unknown
  Description of Unknown: bacterium polynucleotide
  EC1113
tacggggggggcaagcgttgttcggaatcattgggcgtaaagggcgcgtaggcggtgctgtaagtctggtgtgaaatccccgagcttaactcgggacccgcgccagagactgcagtgctcgagtgtgggagaggaaagtggaattcccggtgtagcggtgaaatgcgtagatatcgggaggaacacccgtggcgaaggcggctttctggaccactactgacgctgaggcgcgaaagccgggggagcaaacagg

SEQ ID NO: 1718 - DNA, 253 bp, Unknown
  Description of Unknown: bacterium polynucleotide
  EC1113
tacggggggggcgagcgttgttcggaattattgggcgtaaagggcgcgtaggcggtgtggtaagtctgatgtgaaaactccaggctcaacttggagattgcatcagaaactgccgtgctagagtgtgggagaggagagtggaattcccggtgtagcggtgaaatgcgtagatatcgggaggaacacctgtggcgaaagcggctcactggaccacaactgacgctgaggcgcgaaagctaggggagcaaacagg

SEQ ID NO: 1719 - DNA, 253 bp, Unknown
  Description of Unknown: bacterium polynucleotide
  Ellin6529
tacgtaggtggcaagcgttgtccggatttactgggcgtaaagagcgcgcaggcggtcgttcaagtcgcgtgtgaaagcccccggctcaactggggagggtcacgcgatactgatcgactcgaaggcaggagagggtagtggaattcccggtgtagtggtgaaatgcgtagatatcgggaggaacaccagtggcgaaggcgactacctggcctgttcttgacgctgaggcgcgaaagctaggggagcaaacggg

SEQ ID NO: 1720 - DNA, 254 bp, Unknown
  Description of Unknown: bacterium polynucleotide
  Ellin6529
tacgggggggggcaagcgttgtccggatttactgggcgtaaagagcgcgcaggcggtcgtccaagtcgcgtgtgaaagcccccggcacaactggggagggtcacgcgatactggtcgactcgaaggcaggagagggtagtggaattcccggtgtagtggtgaaatgcgtagatatcgggaggaacaccagtggcgaaggcgactacctggcctgttcttgacgctgaggcgcgaaagctaggggagcaaacggg

SEQ ID NO: 1721 - DNA, 253 bp, Unknown
  Description of Unknown: bacterium polynucleotide
  Ellin6529
tacgtaggtggcaagcgttgtccggatttactgggcgtaaagagcgcgcaggcggtcgattaagtcgagtgtgaaagcccccggctcaactggggagggtcacttgatactggtcgactcgaaggcaggagagggaagtggaattcccggtgtagtggtgaaatgcgtagatatcgggaggaacaccagtggcgaaggcgacttcctggcctgttcttgacgctgaggcgcgaaagctaggggagcaaacggg

SEQ ID NO: 1722 - DNA, 253 bp, Unknown
  Description of Unknown: bacterium polynucleotide
  Ellin6529
tacgtaggtggcaagcgttgtccggatttactgggcgtaaagagcgcgcaggcggtcggatgagtcgaatgtgaaagcccccggcttaactggggagggtcattcgatactgttcgactcgaaggcaggagagggaagcggaattcccggcgtagtggtgaaatgcgtagatatcgggaggaacaccagtggcgaaggcggcttcctggcctgttcttgacgctgaggcgcgaaagctaggggagcaaacggg

SEQ ID NO: 1723 - DNA, 253 bp, Unknown
  Description of Unknown: bacterium polynucleotide
  Ellin6529
tacgtaggtgaccagcgttgtccggatttactgggcgtaaagagcgcgcaggcggtcgttaaagtcgagtgtgaaagcccccggctcaactggggagggtcactcgatactgatcgacttgaaggcaggagagggaagcggaattcccggtgtagtggtgaaatgcgtagatatcgggaggaacaccagtggcgaaggcggcttcctggcctgttcttgacgctgaggcgcgaaagctaggggagcaaacggg

SEQ ID NO: 1724 - DNA, 253 bp, Unknown
  Description of Unknown: bacterium polynucleotide
  Ellin6529
tacgtaggtggcaagcgttgtccggatttactgggcgtaaagagcgcgcaggcggttgtgcaagtcgcgtgtgaaagcccccggctcaactggggagggtcacgcgatactgctcaactcgaaggcaggagagggaagtggaattcccggtgtagtggtgaaatgcgtagatatccagaggaacaccagtggcgaaggcggctcactgggctccacctgacgctgaggcgcgaaagcgtggggagcgaaccgg

SEQ ID NO: 1725 - DNA, 253 bp, Unknown
  Description of Unknown: bacterium polynucleotide
  Elusimicrobia
tacgtaggtggcaagcgatactcggaatcactaggcgtaaagcgcaggtaggcggcttggtaagtcttttgtgaaagctcccggcttaactgggagaggtcaagggaaactaccgggctagagagtggcagaggaagctggaattcccggtgtagcggtgaaatgcgtagatatcgggaggaacacctatggcgaaagcaggcttctgggccatctctgacgctgagctgcgaaagctaggggagcaaacagg

SEQ ID NO: 1726 - DNA, 253 bp, Unknown
  Description of Unknown: bacterium polynucleotide
  Elusimicrobia
tacgtaggtggcaagcgatactcggaatcactaggcgtaaagcgcaggtaggcggtttggtaagtctcttgtgaaatctcccggcttaactgggagaggtcaagggaaactaccaggctagagtgtggtaggggatactggaattcctggtgtagcggtgaaatgcgtagatatcaggaggaatacctatggcgaaagcaggtatctgggccatcactgacgctgagctgcgaaagctaggggagcaaacagg

SEQ ID NO: 1727 - DNA, 253 bp, Unknown
  Description of Unknown: bacterium polynucleotide
  Elusimicrobia
tacgaaggtggcaagcgttactcggaattactaggcgtaaagggcaggtaggtggttcgataagtctgttgtgaaagctcccggctcaactgggagaggccaacagaaactatcgggcttgagtatgggagagggtactggaattcccggtgtagcggtgaaatgcgcagagatcgggaggaacaccaatggcgaaagcaggtacctggaccattactgacactcaactgcgaaagctaggggagcaaacagg

SEQ ID NO: 1728 - DNA, 253 bp, Unknown
  Description of Unknown: bacterium polynucleotide
  Elusimicrobia
gacataggtggctagcgttactcggaattactaggcgtaaagggcaggtaggcggttcggtaagtctattgtgaaatcttccggcttaactggaaggggtcaatagatactgccgggcttgagtgtgtgagagggtgctggaattcccggtgtagcggtgaaatgcgtagagatcgggaggaacacctatggcgaaagcaggcacctggcacattactgacgctgagctgcgaaagctaggggagcaaacagg

SEQ ID NO: 1729 - DNA, 253 bp, Unknown
  Description of Unknown: bacterium polynucleotide
  Elusimicrobia
tacgaaggtggcaagcgttactcggaattactaggcgtaaagggcaggtaggcggtttgattagtctgttgtgaaagctcccggcttaactgggagagtgcaatagatactgtcgaacttgagtatgggagagggtactggaattcctggtgtagcggtgaaatgcgcagagatcaggaggaacaccgatggcgaaagcaggtacctggatcattactgacgctcagctgcgaaagctaggggagcaaacagg

SEQ ID NO: 1730 - DNA, 253 bp, Unknown
  Description of Unknown: bacterium polynucleotide
  Elusimicrobia
tacgaaggtggcaagcgttactcggaattactaggcgtaaagggcaggtaggtggtttggttagtctgttgtgaaagctccctgcttaacggggagaggccaacagatactgccagacttgagtataggagagggtactggaattcctggtgtagcggtgaaatgcgcagagatcaggaggaacaccgatggcgaaagcaggtacctggactattactgacactcagctgcgaaagctaggggagcaaacagg

SEQ ID NO: 1731 - DNA, 253 bp, Unknown
  Description of Unknown: bacterium polynucleotide
  Elusimicrobia
tacgaaggttgcaagcgttactcggaattactaggcgtaaagggcaggtaggtggtttggtaagtctattgtgaaagctcccggcttaaccgggagaggccaatggatactgccaagcttgagtataggagaggttactggaattcccggtgtagcggtgaaatgcgcagatatcgggaggaacaccaatggcgaaagcaggtaactggactattactgacactcaactgcgaaagctaggggagcaaacagg

SEQ ID NO: 1732 - DNA, 253 bp, Arcobacter cryaerophilus
  Epsilonproteobacteria; Campylobacteraceae; Arcobacter cryaerophilus
tacggggggtgcaagcgttactcggaatcactgggcgtaaagagcatgtaggcggattaataagtttgaagtgaaatcctatagcttaactatagaactgctttgaaaactgttagtctagaatgtgggagaggtagatggaatttctggtgtaggggtaaaatccgtagagatcagaaggaataccgattgcgaaggcgatctactggaacattattgacgctgagatgcgaaagcgtggggagcaaacagg

SEQ ID NO: 1733 - DNA, 253 bp, Eubacterium biforme
  Erysipelotrichi; Erysipelotrichaceae; Eubacterium biforme
tacgtaggtggcgagcgttatccggaatgattgggcgtaaagggtgcgtaggtggcagatcaagtctggagtaaaaggtatgggctcaacccgtacttgctctggaaactgatcagctagagaacagaagaggacggcggaactccatgtgtagcggtaaaatgcgtagatatatggaagaacaccggtggcgaaggcggccgtctggtctggattctgacactgaagcacgaaagcgtggggagcaaatagg

SEQ ID NO: 1734 - DNA, 253 bp, Unknown
  Description of Unknown: bacterium polynucleotide
  Fibrobacteria
tacgaggggggcaaatgttgttcggaatcactgggcgtaaagggagcgtaggcgggctcttaagttaggtgtttaatcccggggcccaaccccggacaggcacctaaaactgggagtcttgaatagtggagaggacggcggaattgggggtgtagcggtggaatgcgtagagatccccaagaacaccagttgcgaaggcggccgtctggacacgtattgacgctgaggctcgaaagcatggggagcaaacagg

SEQ ID NO: 1735 - DNA, 253 bp, Unknown
  Description of Unknown: bacterium polynucleotide
  Fibrobacteria
tacgaggggggcaaatgttgttcggaatcactgggcgtaaagggagcgtaggcgggttcttaagttaggtgtttaatcccggggcccaaccccggaccggcacttaaaactgggaatcttgaatagtggagaggtcggtggaattgggggtgtagcggtggaatgcgtagagatccccaagaacaccagttgcgaaggcggccgactggacacatattgacgctgaggctcgaaagcatggggagcaaacagg

SEQ ID NO: 1736 - DNA, 253 bp, Unknown
  Description of Unknown: bacterium polynucleotide
  Fibrobacteria
tacgaggggggcaagtgttgttcggaatcactgggcgtaaagggagcgtaggcggatgtttaagttggatgtttaaaaccggggcccaacctcggagcggcatccaaaactggacgtcttgaatggaacagaggctagtggaattgggggtgtagcggtggaatgcgtagagatccccaagaacaccaattgcgaaggcagctagctgggttcacattgacgctgaggctcgaaagcatggggagcaaacagg

SEQ ID NO: 1737 - DNA, 253 bp, Unknown
  Description of Unknown: bacterium polynucleotide
  Fibrobacteria
tacgaggggggcaagtgttgttcggaattactgggcgtaaagggagcgtaggcggatgtttaagtcgggagtttaaaaccggggcccaaccccggagcggctcccgaaactggatatcttgaataggtcagaggctagtggaattggaggtgtagcggtggaatgcgtagagatctccaagaacacctattgcgaaggcagctagctgggaccatattgacgctgaggctcgaaagcatggggagcaaacagg

SEQ ID NO: 1738 - DNA, 253 bp, Unknown
  Description of Unknown: bacterium polynucleotide
  Fibrobacteria
gacgaggggtccaagcgttgttcggaatcactgggcgtaaagggagcgtaggcggatgtttaagtcgggtgtttaaaaccggggcccaaccccggagcggcacccgaaactgggcatcttgaataggtcagaggctggtggaattggaggtgtagcggtggaatgcgtagagatctccaagaacacctattgcgaaggcagccagctgggaccatattgacgctgaggctcgaaagcatggggagcaaacagg

SEQ ID NO: 1739 - DNA, 253 bp, Unknown
  Description of Unknown: bacterium polynucleotide
  Fibrobacteria
tacgaggggggcaagtgttgttcggaatcactgggcgtaaagggagcgtaggcggaagcttaagtcgggagtttaaaaccggggcccaaccccggggcggctcccgaaactgggtttcttgaatgggacagaggctggtggaattgggggtgtagcggtggaatgcgtagagatccccaagaacaccgattgcgaaggcagccagctgggtccacattgacgctgaggctcgaaagcatggggagcaaacagg

SEQ ID NO: 1740 - DNA, 253 bp, Unknown
  Description of Unknown: bacterium polynucleotide
  Fibrobacteria
tacgaggggggcaaatgttgttcggaatcactgggcgtaaagggagcgtaggcgggtttttaagttaggtgtttaatcccggggcccaaccccggacaggcacctaaaactggaaatcttgaataggggagaggtcggtggaattggaggtgtagcggtggaatgcgtagagatctccaagaacaccagttgcgaaggcggccgactggacccatattgacgctgaggctcgaaagcatggggagcaaacagg

SEQ ID NO: 1741 - DNA, 253 bp, Unknown
  Description of Unknown: bacterium polynucleotide
  Fibrobacteria
tacgaggggggcaagtgttgtttggaatcactgggcgtaaagggagcgtaggcggacgtttaagtcgggtgtttaaaaccggggcccaaccccggggcggcacccgaaactggacgtcttgaatgggacagaggctggtggaattggggatgtagcggtggaatgcgtagagatccccaagaacaccgattgcgaaggcagccagctgggtccacattgacgctgaggctcgaaagcatggggagcaaacagg

SEQ ID NO: 1742 - DNA, 254 bp, Unknown
  Description of Unknown: bacterium polynucleotide
  Fibrobacteria
tacgaaggggggcaaatgttgttcggaatcactgggcgtaaagggagcgtaggcgggcttttaagttaggtgtttaatcccggggcccaaccccggacaggcacctaaaactgggagtcttgaatagtggagaggtcagtggaattggaggtgtagcggtggaatgcgtagagatctccaagaacaccagttgcgaaggcggctgactggacacatattgacgctgaggctcgaaagcatggggagcaaacagg

SEQ ID NO: 1743 - DNA, 253 bp, Unknown
  Description of Unknown: bacterium polynucleotide
  Flavobacteriia; Weeksellaceae
tacggagggtgcaagcgttatccggacttattgggtttaaagggtccgtaggcgggttattaagtcagtggtgaaatctcatagctcaactatgaaactgccattgatactgatagtcttgagtatatttgaagtagctggaataagtagtgtagcggtgaaatgcatagatattacttagaacaccaatagcgaaggcaggttactaagatattactgacgctgagggacgagagcgtagggagcgaacagg

SEQ ID NO: 1744 - DNA, 253 bp, Unknown
  Description of Unknown: bacterium polynucleotide
  Flavobacteriia; Weeksellaceae
tacggagggtgcaagcgttatccggatttattgggtttaaagggtccgtaggcgggtcgataagtcagtggtgaaagcctgcagcttaactgtagaactgccgttgatactgtcggtcttgagtgtatttgaggtagctggaatgagtagtgtagcggtgaaatgcatagatattactcagaacaccaattgcgaaggcaggttaccaagttacaactgactctgatggacgaaagcgtggggagcgaacagg

SEQ ID NO: 1745 - DNA, 253 bp, Unknown
  Description of Unknown: bacterium polynucleotide
  Flavobacteriia; Weeksellaceae
tacggagggtgcaagcgttatccggatttattgggtttaaagggtccgtaggtgggttagtaagtcagtggtgaaatcctgcagcttaactgtagaactgccattgatactgctagtcttgagtgtatttgaagtagctggaataagtagtgtagcggtgaaatgcatagatattacttagaacaccaattgcgaaggcaagttactaagatacaactgacgctgagggacgaaagcgtggggagcaaacagg

SEQ ID NO: 1746 - DNA, 253 bp, Chryseobacterium sp.
  Flavobacteriia; Weeksellaceae; Chryseobacterium
tacggagggtgcaagcgttatccggatttattgggtttaaagggtccgtaggcggatctgtaagtcagtggtgaaatctttcggcttaaccggaaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 1747 - DNA, 253 bp, Chryseobacterium sp.
  Flavobacteriia; Weeksellaceae; Chryseobacterium
tacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacagg

SEQ ID NO: 1748 - DNA, 253 bp, Chryseobacterium sp.
  Flavobacteriia; Weeksellaceae; Chryseobacterium
tacggagggtgcaagcgttatccggatttattgggtttaaggggtccgtaggcgggctcgtaagtcagtggtgaaatctcatagcttaactatgaaactgccattgatactgcgagccttgagtaaggtagaggtagctggaataagtagtgtagcggtgaaatgcatagatattacttagaacaccaattgcgaaggcaggttaccatgtcttaactgacgctgatggacgaaagcgtggggagcgaacagg

SEQ ID NO: 1749 - DNA, 253 bp, Chryseobacterium sp.
  Flavobacteriia; Weeksellaceae; Chryseobacterium
tactgagggtgcaagcgttatccggatttactaggtttaaagggtccgtaggcggatctgtaagtcagtggtgaaatctcatagctcaactatgaaactgccattgatactgcaggtcttgagtaaggtagaagtagctggaataagtagcgtagcggtgaaatgcatagatattacttagaacaccaattgcgaaggcaggttactatgtcttaactgacgctgatggacgaaagcgtggggagcgaacagg

SEQ ID NO: 1750 - DNA, 253 bp, Chryseobacterium sp.
  Flavobacteriia; Weeksellaceae; Chryseobacterium
tacggagggtgcaagcgttatccggatttattgggtttaaagggtccgtaggcgggctagtaagtcagtggtgaaatctcgatgcttaacatcgaaactgccattgatactgctagccttgagtaaggtagaggtagctggaataagtagcgtagcggtgaaatgcatagatattacttagaacaccaattgcgaaggcaggttaccatgtcttaactgacgctgagggacgaaagcgtggggagcgaacagg

SEQ ID NO: 1751 - DNA, 253 bp, Chryseobacterium sp.
  Flavobacteriia; Weeksellaceae; Chryseobacterium
tacggagggtgcaagcgttatccggatttattgggtttaaagggtccgtaggcggatccgtaagtcagtggtgaaatctcatagcttaactatgaaactgccattgatactgcgggtcttgagtgagattgaggtagctggaataagtagtgtagcggtgaaatgcatagatattacttagaacaccaattgcgaaggcaggttaccaagtcttaactgacgctgatggacgaaagcgtggggagcgaacagg

SEQ ID NO: 1752 - DNA, 253 bp, Cloacibacterium sp.
  Flavobacteriia; Weeksellaceae; Cloacibacterium
tacggagggtgcaagcgttatccggatttattgggtttaaagggtccgtaggcggacttataagtcagtggtgaaagcctgtcgcttaacgatagaactgccattgatactgtaagtcttgagtatatttgaggtagctggaataagtagtgtagcggtgaaatgcatagatattacttagaacaccaattgcgaaggcaggttaccaagatataactgacgctgagggacgaaagcgtggggagcgaacagg

SEQ ID NO: 1753 - DNA, 253 bp, Elizabethkingia meningoseptica
  Flavobacteriia; Weeksellaceae; Elizabethkingia meningoseptica
tacggagggtgcaagcgttatccggatttattgggtttaaagggtccgtaggcggactagtaagtcagtggtgaaatccgacagcttaactgtcgaactgccattgatactgctagtcttgagtaaggttgaagtggctggaataagtagtgtagcggtgaaatgcatagatattacttagaacaccaattgcgaaggcaggtcactaagtcttaactgacgctgatggacgaaagcgtggggagcgaacagg

SEQ ID NO: 1754 - DNA, 253 bp, Unknown
  Description of Unknown: bacterium polynucleotide
  Flavobacteriia; Cryomorphaceae
tacggagggtgcaagcgttatccggattcattgggtttaaagggtgcgtaggcggggtggtaagtcagtggtgaaatcctgcagctcaactgtagaattgccattgatactgccattcttgagtgcgcttgaagtaggcggaatgtgccgtgtagcggtgaaatgcttagatatggcacagaacaccaattgcgaaggcagcttactaaggcgatactgacgctgaggcacgaaagcgtggggatcgaacagg

SEQ ID NO: 1755 - DNA, 253 bp, Crocinitomix sp.
  Flavobacteriia; Cryomorphaceae; Crocinitomix
tacggagggtccaagcgttatccggaatcattgggtttaaagggtgcgcaggcggtaaagtaagtcagtggtgaaatcccttcgctcaacgaaggaactgccattgatactgctatacttgaatatagttgaagtaggcggaatgtgtagtgtagcggtgaaatgcttagatattacacagaacaccgatagcgaaggcagcttactaaactaatattgacgctcatgcacgaaagcgtggggagcgaacagg

SEQ ID NO: 1756 - DNA, 253 bp, Crocinitomix sp.
  Flavobacteriia; Cryomorphaceae; Crocinitomix
tatggggggtccaagcgttatccggaatcattgggtttaaagggtgcgcaggcggtaaagtaagtcagtggtgaaatcccttcgctcaacgaaggaactgccattgatactgctatacttgaatacagttggagtgggcggaatgtgtagtgtagcggtgaaatgcttagatattacacagaacaccgatagcgaaggcagcttactaaactgagattgacgctcatgcacgaaagcctggggagcgaacagg

SEQ ID NO: 1757 - DNA, 253 bp, Fluviicola sp.
  Flavobacteriia; Cryomorphaceae; Fluviicola
tacggagggtgcaagcgttatccggaatcattgggtttaaagggtccgcaggcggtctaataagtcagtggtgaaagcctacagctcaactgtagaactgccattgatactgtaggacttgaatgtggtcgaagtgggcgggatgtgacatgtagcggtgaaatgcatagatatgtcacagaacaccgatagcgaaggcagctcactaggccatgattgacgctcatggacgaaagcgtggggagcaaacagg

SEQ ID NO: 1758 - DNA, 253 bp, Fluviicola sp.
  Flavobacteriia; Cryomorphaceae; Fluviicola
tacggagggtgcaagcgttatccggaatcattgggtttaaagggtccgcaggcgggaagataagtcagtggtgaaatctcacagctcaactgtgaaactgccattgatactgtctttcttgaattcgatcgaagtgggcggaatgtgacatgtagcggtgaaatgcttagatatgtcacagaacaccgatagcgaaggcagctcactaggtctggattgacgctcagggacgaaagcgtggggagcaaacagg

SEQ ID NO: 1759 - DNA, 253 bp, Fluviicola sp.
  Flavobacteriia; Cryomorphaceae; Fluviicola
tacggagggtgcaagcgttatccggaatcattgggtttaaagggtccgcaggcggtcttataagtcagtggtgaaagcctacagctcaactgtagaactgccattgatactgtaagacttgaattcgatcgaagtgggcggaatatgacatgtagcggtgaaatgcttagatatgtcatagaacaccgatagcgaaggcagctcactaggtctggattgacgctcagggacgaaagcgtggggagcaaacagg

SEQ ID NO: 1760 - DNA, 253 bp, Fluviicola sp.
  Flavobacteriia; Cryomorphaceae; Fluviicola
tacggagggtgcaagcgttatccggaatcattgggtttaaagggtccgcaggcggaagaataagtcagtggtgaaatctctcggctcaaccgagaaactgccattgatactgttcttcttgaattcgatcgaagtgggcggaatgtgacatgtagcggtgaaatgcttagatatgtcacagaacaccgatagcgaaggcagctcactaggtctggattgacgctcagggacgaaagcgtggggagcaaacagg

SEQ ID NO: 1761 - DNA, 253 bp, Fluviicola sp.
  Flavobacteriia; Cryomorphaceae; Fluviicola
tacggagggtgcaagcgttatccggaatcattgggtctaaagggtccgcaggcggatttataagtcagtggtgaaagcccgtcgctcaacgacggaactgccattgatactgtaagtcttgaattcggtcgaagtgggcggaatatgacatgtagcggtgaaatgcttagatatgtcatagaacaccgatagcgaaggcagctcactaggcctggattgacgctcagggacgaaagcgtggggagcaaacagg

SEQ ID NO: 1762 - DNA, 253 bp, Fluviicola sp.
  Flavobacteriia; Cryomorphaceae; Fluviicola
tacggagggtgcaagcgttatccggaatcattgggtttaaagggtccgcaggcggatttataagtcagtggtgaaagcctgatgctcaacatcagaactgccattgatactgtaagtcttgaattcgatcgaagtgggcggaatatgacatgtagcggtgaaatgcttagatatgtcatagaacaccgatagcgaaggcagctcactaggtctggattgacgctcagggacgaaagcgtggggagcaaacagg

SEQ ID NO: 1763 - DNA, 253 bp, Fluviicola sp.
  Flavobacteriia; Cryomorphaceae; Fluviicola
tacggagggtgcaagcgttatccggaatcattgggtttaaagggtccgcaggcggacctataagtcagtggtgaaagcccgttgctcaacaacggaactgccattgatactgtaggtcttgaattcggtcgaagtgggcggaatgtgacatgtagcggtgaaatgcttagatatgtcacagaacaccgatagcgaaggcagctcactaggcctggattgacgctcatggacgaaagcgtggggagcaaacagg

SEQ ID NO: 1764 - DNA, 253 bp, Aequorivita sp.
  Flavobacteriia; Flavobacteriaceae; Aequorivita
tacggagggtgcaagcgttgtccggatttattgggtttaaagggtccgtaggcgggcgtctaagtcagtggtgaaatcccgcagctcaactgtggaattgccattgatactggtcgccttgaattagtgtgaagtggctagaatatgtagtgtagcggtgaaatgcttagatattacatagaataccgattgcgaaggcaggtcactaacactatattgacgctgatggacgaaagcgtggggagcgaacagg

SEQ ID NO: 1765 - DNA, 253 bp, Aequorivita sp.
  Flavobacteriia; Flavobacteriaceae; Aequorivita
tacggaggatccaagcgttatccggaatcattgggtttaaagggtccgtaggcggacggctaagtcagtggtgaaagtctgcagctcaactgtagaaatgccattgatactggttgtcttgaatcgttgtgaagtggctagaatatgtggtgtagcggtgaaatgcttagatatcacatagaataccgattgcgaaggcaggtcactaacaacgtattgacgctgatggacgaaagcgtggggagcggacagg

SEQ ID NO: 1766 - DNA, 253 bp, Aequorivita sp.
  Flavobacteriia; Flavobacteriaceae; Aequorivita
tacggaggatccaagcgttatccggaatcattgggtttaaagggtccgtaggcggacgattaagtcagcggtgaaagtctgcagctcaactgtagaactgccgttgatactggttgtcttgaatcaatgtgaagtggctagaatatgtggtgtagcggtgaaatgcttagatatcacatagaacaccgattgcgaaggcaggtcactaacattgtattgacgctgatggacgaaagcgtggggagcgaacagg

SEQ ID NO: 1767 - DNA, 253 bp, Capnocytophaga ochracea
  Flavobacteriia; Flavobacteriaceae; Capnocytophaga ochracea
tacggaggatgcgagcgttatccggaatcattgggtttaaagggtccgtaggcgggctgataagtcaggggtgaaatcgttcagctcaactgagcaactgcctttgaaactgttagtcttgaatagttgtgaagtagttggaatgtgtagtgtagcggtgaaatgcttagagattacacagaacaccgatagcgaaggcatattactaacaattgattgacgctgacggacgaaagcggggggagcgaacagg

SEQ ID NO: 1768 - DNA, 253 bp, Flavobacterium sp.
  Flavobacteriia; Flavobacteriaceae; Flavobacterium
tacggaggatccaagcgttatccggaatcattgggtttaaagggtccgtaggcggccctgtaagtcagtggtgaaatctcccggctcaaccgggaaattgccattgatactgcagggcttgaattgccgggaagcaactagaatatgtagtgtagcggtgaaatgcttagatattacatggaataccgattgcgaaggcaggttgctaccggcgtattgacgctgatggacgaaagcgtgggtagcgaacagg

SEQ ID NO: 1769 - DNA, 253 bp, Flavobacterium sp.
  Flavobacteriia; Flavobacteriaceae; Flavobacterium
tacggaggatccaagcgttatccggaatcattgggtttaaagggtccgtaggcgggcctgtaagtcagtggtgaaatctttcggctcaaccggaaaattgccattgatactgcaggccttgaattattgggaagtaactagaatatgtagtgtagcggtgaaatgcttagatattacatggaataccgattgcgaaggcaggttactaccaatacattgacgctgatggacgaaagcgtggggagcgaacagg

SEQ ID NO: 1770 - DNA, 253 bp, Flavobacterium columnare
  Flavobacteriia; Flavobacteriaceae; Flavobacterium columnare
tacggaggatccaagcgttatccggaatcattgggtttaaagggtccgtaggcggttttataagtcagtggtgaaatctggtcgctcaacgatcaaacggccattgatactgtagaacttgaattacttggaagtaactagaatatgtagtgtagcggtgaaatgcttagagattacatggaataccaattgcgaaggcaggttactacgagtatattgacgctgatggacgaaagcgtggggagcgaacagg

SEQ ID NO: 1771 - DNA, 253 bp, Flavobacterium succinicans
  Flavobacteriia; Flavobacteriaceae; Flavobacterium succinicans
tacggaggatccaagcgttatccggaatcattgggtttaaagggtccgtaggcggtttggtaagtcagtggtgaaagcccatcgctcaacggtggaacggccattgatactgccagacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 1772 - DNA, 253 bp, Flavobacterium sp.
  Flavobacteriia; Flavobacteriaceae; Flavobacterium
tacggaggatccaagcgttatccggaatcattgggtttaaagggtccgtaggcggccttataagtcagtggtgaaatctcccggctcaaccgggaaattgccattgatactgtagggcttgaattattaggaagtaactagaatatgtagtgtagcggtgaaatgcttagagattacatggaataccaattgcgaaggcaggttactactaatggattgacgctgatggacgaaagcgtggggagcaaacagg

SEQ ID NO: 1773 - DNA, 253 bp, Flavobacterium sp.
  Flavobacteriia; Flavobacteriaceae; Flavobacterium
tacggaggatccaagcgttatccggaatcattgggtttaaagggtccgtaggcggcttgataagtcagtggtgaaagcccatcgctcaacgatggaacggccattgatactgtcagacttgaattactgggaagtaactagaatatgtagtgtagcggtgaaatgcttagatattacatggaataccaattgcgaaggcaggttactaccagtggattgacgctgatggacgaaagcgtggggagcgaacagg

SEQ ID NO: 1774 - DNA, 253 bp, Flavobacterium sp.
  Flavobacteriia; Flavobacteriaceae; Flavobacterium
tacggaggatccaagcgttatccggaatcattgggtttaaagggtccgtaggcggccaggtaagtcagtggtgaaagcccatcgctcaacggtggaacggccattgatactgccaggcttgaatttctgggaagtaactagaatatgtagtgtagcggtgaaatgcttagatattacatggaataccaattgcgaaggcaggttactaccagtggattgacgctgatggacgaaagcgtgggtagcgaacagg

SEQ ID NO: 1775 - DNA, 253 bp, Flavobacterium succinicans
  Flavobacteriia; Flavobacteriaceae; Flavobacterium succinicans
tacggaggatccaagcgttatccggaatcattgggtttaaagggtccgtaggcggtttagtaagtcagtggtgaaagcccatcgctcaacggtggaacggccattgatactgctgaacttgaattactaggaagtaactagaatatgtagtgtagcggtgaaatgcttagatattacatggaataccaattgcgaaggcaggttactactaacggattgacgctgatggacgaaagcgtggggagcgaacagg

SEQ ID NO: 1776 - DNA, 253 bp, Flavobacterium sp.
  Flavobacteriia; Flavobacteriaceae; Flavobacterium
tacggaggatccaagcgttatccggaatcattgggtttaaagggtccgtaggcggtcttgtaagtcagtggtgaaagcccatcgcttaacgatggaacggccattgatactgtaggacttgaattattgggaagtaactagaatatgtagtgtagcggtgaaatgcttagatattgcatggaataccaattgcgaaggcaggttactatcaatatattggcgctgatggacgaaagcgtggggagcaaacagg

SEQ ID NO: 1777 - DNA, 253 bp, Flavobacterium sp.
  Flavobacteriia; Flavobacteriaceae; Flavobacterium
tacggaggatccaagcgttatccggaatcattgggtttaaagggtccgtaggcggttttataagtcagtggtgaaatccggcagcttaactgtcgaactgccattgatactgtagaacttgaattattgtgaagtaactagaatatgtagtgtagcggtgaaatgcttagatattacatggaataccaattgcgaaggcaggttactaacaatacattgacgctgatggacgaaagcgtggggagcgaacagg

SEQ ID NO: 1778 - DNA, 253 bp, Flavobacterium succinicans
  Flavobacteriia; Flavobacteriaceae; Flavobacterium succinicans
tacggaggatccgagcgttatccggaatcattgggtttaaagggtccgtaggcggtttaataagtcagtggtgaaagcccatcgctcaacggtggaacggccattgatactgttaaacttgaattattaggaagtaactagaatatgtagtgtagcggtgaaatgcttagagattacatggaataccaattgcgaaggcaggttactactaatgggttggcgctgatggacgaaagcgtgggtagcgaacagg

SEQ ID NO: 1779 - DNA, 253 bp, Flavobacterium succinicans
  Flavobacteriia; Flavobacteriaceae; Flavobacterium succinicans
tacggaggatccaagcgttacccggaatcattgggtttaaagggtccgtaggcggtctggtaagtcagtggtgaaagcccatcgctcaacggtggaacggccattgatactgccagacttgaattactaggaagcaactagaatatgtagtgtagcggtgaaatgcttagatattacatggaataccaattgcgaaggcaggttgctactagttgattgacgctgatggacgaaagcgtgggtagcgaacagg

SEQ ID NO: 1780 - DNA, 253 bp, Flavobacterium succinicans
  Flavobacteriia; Flavobacteriaceae; Flavobacterium succinicans
tacggaggatccaagcgttatccggagtcattgggtttaaagggtccgtaggcggtcttgtaagtcagtggtgaaagcccatcgctcaacgatggaacggccattgatactgcaggacttgaattattgggaagtaactagaatatgtagtgtagcggtgaaatgcttagatattacatggaataccaattgcgaaggcaggttactaccaatttattgacgctgatggacgaaagcgtggggagcgaacagg

SEQ ID NO: 1781 - DNA, 253 bp, Flavobacterium sp.
  Flavobacteriia; Flavobacteriaceae; Flavobacterium
tacggaggatccaagcgttatccggaatcattgggtttaaagggtccgtaggcgggtttataagtcagtggcgaaagcccgtcgctcaacgatggaacggccattgatactgtagatcttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 1782 - DNA, 253 bp, Flavobacterium sp.
  Flavobacteriia; Flavobacteriaceae; Flavobacterium
tacggaggatccaagcgttatccggaatcattgggtttaaagggtccgtaggcggttttgtaagtcagtggtgaaatccggcagctcaactgtcgcactgccattgatactgcaggacttgaattattgtgaagtaactagaatatgtagtgtagcggtgaaatgcttagatattacatggaatacccattgcgagggcaggttactaacaatatattgacgctgatggacgaaagcgtggggagcgaacagg

SEQ ID NO: 1783 - DNA, 253 bp, Flavobacterium sp.
  Flavobacteriia; Flavobacteriaceae; Flavobacterium
tacggagggtgtaagcgttatccggaatcattgggtttaaagggtccgcaggcggtcttataagtcagtggtgaaatccggcagcttaactatcgaactgccattaatactgtaggacttgaattattatgaagtaactagaatatgtagtgtagcggtgaaatgcttagatattacatggaataccaattgcgaaggcaggttactaataatggattgacgctgatggacgaaagcgtggggagcgaacagg

SEQ ID NO: 1784 - DNA, 253 bp, Flavobacterium sp.
  Flavobacteriia; Flavobacteriaceae; Flavobacterium
tacggaggatccaagcgttatccggaatcattgggtttaaagggtccgtaggcggttttgagaatcagtggtgaaatctggtcgctcaacgatcaaacggccattgatactgcagaacttgaattattgtgaagtaactagaatatgtagtgtagcggtgaaatgcttagatattacacggaataccgattgcgaaggcaggttactaacaatatattgacgctgatggacgaaagcgtggggagcgaacagg

SEQ ID NO: 1785 - DNA, 253 bp, Flavobacterium succinicans
  Flavobacteriia; Flavobacteriaceae; Flavobacterium succinicans
tacgaaggtcccgagcgttgttcggaatcactgggcgtaaagggagcgtaggcggtttagtaagtcagtggtgaaagcccatcgctcaacggtggaacggccattgatactgctaaacatgaattattaggaagtaactagaatatgtagtgtagcggtgaaatgcttagagattacatggaataccaattgcgaaggcaggttactactaatggattgacgctgatggacgaaagctaggggagcgaatggg

SEQ ID NO: 1786 - DNA, 253 bp, Flavobacterium sp.
  Flavobacteriia; Flavobacteriaceae; Flavobacterium
tacggaggatccaagcgttatccggaatcattgggtttaaagggtccgtaggcggccttataagtcagcggtgaaagtttttggcttaaccaaaaaattgccattgatactgtagggcttgaattattgtgaagtaactagaatatgtagtgtagcggtgaaatgcttagatattacatggaataccaattgcgaaggcaggttactaacaatggattgacgctgatggacgaaagcgtgggtagcgaacagg

SEQ ID NO: 1787 - DNA, 253 bp, Flavobacterium sp.
  Flavobacteriia; Flavobacteriaceae; Flavobacterium
tacggaggatccaagcgttatccggaatcattgggtttaaagggtccgtaggcgggcctgtaagtcagtggtgaaatctccccgctcaacggggaaacggccattgatactgcaggccttgaattatcaggaagtaactagaatatgtagtgtagcggtgaaatacttagatattacatggaataccaactgcgaaggcaggttactactggtggattgacgctgatggacgaaagcgtgggtagcgaacagg

SEQ ID NO: 1788 - DNA, 253 bp, Winogradskyella sp.
  Flavobacteriia; Flavobacteriaceae; Winogradskyella
tacggaggatccaagcgttatccggaatcattgggtttaaagggtccgtaggtggataattaagtcagaggtgaaatcctgcagctcaactgtagaattgcctttgatactggttatcttgaattattgtgaagtagttagaatatgtagtgtagcggtgaaatgcatagatattacatagaataccaattgcgaaggcagattactaacaatatattgacactgatggacgaaagcgtggggagcaaacagg

SEQ ID NO: 1789 - DNA, 252 bp, Unknown
  Description of Unknown: bacterium polynucleotide
  Fusobacteriia; Fusobacteriaceae
tacgtatgtcgcaagcgttatccggatttattgggcgtaaagcgcgtctaggcggtttggtaagtctgatgtgaaaatgcggggctcaactccgtattgcgttggaaactgccaaactagagtactggagaggtaggcggaactacaagtgtagaggtgaaattcgtagatatttgtaggaatgccgatggggaagccagcctactggacagatactgacgctaaagcgcgaaagcgtgggtagcaaacagg

SEQ ID NO: 1790 - DNA, 252 bp, Fusobacterium sp.
  Fusobacteriia; Fusobacteriaceae; Fusobacterium
tacgtatgtcacaagcgttatccggatttattgggcgtaaagcgcgtctaggtggtcatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacagg

SEQ ID NO: 1791 - DNA, 252 bp, Fusobacterium sp.
  Fusobacteriia; Fusobacteriaceae; Fusobacterium
tacgtatgtcgcaagcgttatccggatttattgggcgtaaagcgcgtctaggcggctagataagtctgatgtgaaaatgcggggctcaactccgtatcgcgttggaaactgtatagctagagtactggagaggtaagcggaactacaagtgtagaggtgaaattcgtagatatttgtaggaatgccgatggggaagccagcttactggacagatactgacgctgaagcgcgaaagcgtgggtagcaaacagg

SEQ ID NO: 1792 - DNA, 253 bp, Leptotrichia sp.
  Fusobacteriia; Leptotrichiaceae; Leptotrichia
tacgtatgtcgcgagcgttatccggaattattgggcataaagggcatctaggcggatatacaagtcaggggtgaaaacttagggctcaactcaaagcttgcctttgaaactgtatatctagagtgctggagaggtggacggaactacacgagtagaggtgaaattcgtagatatgtgtaggaatgccgatgatgaagatagtccactggacagcaactgacgctgaagtgcgaaagctaggggagcaaacagg

SEQ ID NO: 1793 - DNA, 253 bp, Leptotrichia sp.
  Fusobacteriia; Leptotrichiaceae; Leptotrichia
tacgtatgtcgcaagcgttatccggaattattgggcataaagggcatctaggcggccagataagtctggggtgaaaacttgcggctcaaccgcaagcctgccctggaaactatgtggctagagtactggagaggtggacggaactgcacgagtagaggtgaaattcgtagatatgtgcaggaatgccgatgatgaagatagttcactggacggtaactgacgctgaagtgcgaaagctaggggagcaaacagg

SEQ ID NO: 1794 - DNA, 252 bp, Unknown
  Description of Unknown: bacterium polynucleotide
  Gammaproteobacteria
tacagagggtgcgagcgttaatcggaattactgggcgtaaagggcgcgtaggtggtttgataagatggttgtgaaatacctggcttaacctaggaatggcaatcaagactgttagacttgagtacggtagaggatagtggaatttccggtgtagcggtgaaatgcgtagagatcggaaggaacaccagtggcgaaggcgactatctggactgatactgacactgaggcgcgaaagcgtggggagcgaacagg

SEQ ID NO: 1795 - DNA, 253 bp, Unknown
  Description of Unknown: bacterium polynucleotide
  Gammaproteobacteria
tacagagggtgcaagcgttaatcggaattactgggcgtaaagcgcacgtaggtggcttggtaagttggatgtgaaatccccgggcttaacttgggaattgcattcaagactgccttgctagagtgtggaagagggaagcggaattccaggtgtagcggtgaaatgcgtagatatctggaggaacatcagtggcgaaggcggcttcctggtccaacactgacactgaggtgcgaaagcgtggggagcaaacagg

SEQ ID NO: 1796 - DNA, 253 bp, Unknown
  Description of Unknown: bacterium polynucleotide
  Gammaproteobacteria
tacagagggtgcaagcgttaatcggaattactgggcgtaaagggtgcgtaggtggttaaataagttatgtgtgaaagtcctgggcttaacctggggattgcgcctaatactgatgagctagagtactgtagaggaaggtggaatttccggtgtagcggtgaaatgcgtagatatcggaaggaacaccagtggcgaaggcgaccttctggacagatactgacactgaggcacgaaagcgtggggagcaaacagg

SEQ ID NO: 1797 - DNA, 253 bp, Unknown
  Description of Unknown: bacterium polynucleotide
  Gammaproteobacteria
tacgaagggtgcaagcgttaatcggatttactgggcgtaaagcgtgcgtaggcggccagaccagtcggatgtgaaatccccgagcttaacttgggaactgcatccgaaactatctggctagagtgtggtagagggcggtggaattcccggtgtagcggtgaaatgcgtagatatcgggaggaacatcaatggcgaaggcagccgcctgggccaacactgacgctgaggtacgaaagcgtggggagcaaacagg

SEQ ID NO: 1798 - DNA, 253 bp, Unknown
  Description of Unknown: bacterium polynucleotide
  Gammaproteobacteria
tacggaaggtgcgagcgttaatcggaattactgggcgtaaagcgcacgtaggtggttttataagtcggatgtgaaagccccgggcttaacctgggaattgcatctgatactgtctgactagagtatgctagagggaagtggaattccaggtgtagcggtgaaatgcgtagatatctggaggaacaccaatggcgaaggcaacttcctggggcaatactgacactgatgtgcgaaagcgtggggagcaaacagg

SEQ ID NO: 1799 - DNA, 253 bp, Unknown
  Description of Unknown: bacterium polynucleotide
  Gammaproteobacteria
tacggagggtgcgagcgttaatcggaatgactgggcgtaaagggcgcgtaggcgggacaataagtcagttgtgaaagtgccgggctcaacctggtaacgtcgattgaaactgttgttcttgagtttcacagaggaaggcggaattccaggtgtagcggtgaaatgcgcagatatctggaggaacaccggtggcgaaggcggccttctgggtgggaactgacgctgaggcgcgaaggcgtggggagcaaacagg

SEQ ID NO: 1800 - DNA, 253 bp, Unknown
  Description of Unknown: bacterium polynucleotide
  Gammaproteobacteria
tacggagggtgcaagcgttaatcggaattactgggcgtaaagcgcgcgtaggcggctgagtaagtcgattgtgaaatccccgggctcaacctgggaattgcagtcgagactgctcggctagagtgtgggagagggtggtggaattcccggtgtagcggtgaaatgcgtagatatcgggaggaacatcagtggcgaaggcgaccgcctggcccaacactgacgctgaggtgcgaaagcgtgggtagcaaacagg

SEQ ID NO: 1801 - DNA, 253 bp, Unknown
  Description of Unknown: bacterium polynucleotide
  Gammaproteobacteria
tacagagggtgctagcgttaatcggaattactgggcgtaaagagcacgtaggcggatatgtaagtcagatgtgaaatccccgggcttaacctgggaactgcatttgaaactgcatgactagagtagaacagaggaaagtggaatttccggtgtagcggtgaaatgcgtagagatcggaaggaacaccagtggcgaaggcgactttctgggttcatactgacgctgaggtgcgaaagcgtggggagcaaacagg

SEQ ID NO: 1802 - DNA, 253 bp, Unknown
  Description of Unknown: bacterium polynucleotide
  Gammaproteobacteria
tacgaagggtgcaagcgttaatcggaattactgggcgtaaagggtgcgtaggtggtttgataagttaggtgtgaaagccctgggcttaacctgggaactgcgcctaatactgttgaacttgagtactgtagaggaaggtggaatttccggtgtagcggtgaaatgcgtagatatcggaaggaacatcagtggcgaaggcgactttctggacagatactgacactgaggcacgaaagcatggggagcaaacagg

SEQ ID NO: 1803 - DNA, 253 bp, Unknown
  Description of Unknown: bacterium polynucleotide
  Gammaproteobacteria
tacggagggtgcgagcgttaatcggaattactgggcgtaaagcgcacgtaggcggtcatgtaagtgggatgtgaaacccccgggcttaacctgggacttgcataccagactgcatggctagagtatgagagagggtggtggaatttccggtgtagcggtgaaatgcgtagagatcggaaggaacatcagtggcgaaggcggccacctggcttaatactgacgctgaggtgcgaaagcgtggggatcaaacagg

SEQ ID NO: 1804 - DNA, 253 bp, Unknown
  Description of Unknown: bacterium polynucleotide
  Gammaproteobacteria
tacagagggtgcgagcgttaatcggaattactgggcgtaaagggcgcgtaggtggtagcgtgtgaaagatgtgaaagccccgggcttaacctgggaagtgcatctttaactgcgcaactagagtacagcagagggtggcggaatttccggtgtagcggtgaaatgcgtagagatcggaaggaacgtcggtggcgaaggcggccacctgggctgatactgacactgaggcgcgaaagcgtggggagcgaacagg

SEQ ID NO: 1805 - DNA, 253 bp, Unknown
  Description of Unknown: bacterium polynucleotide
  Gammaproteobacteria
tacagagggtgcaagcgttaatcggaattactgggcgtaaagggtgtgtaggtggttgcgtaagttagatgtgaaatccccgggcttaacctgggaactgcgtttaaaactgcgtaactagagtattgcagaggatagtggaatttccagtgtagcggtgaaatgcgtagatgttggaaggaacaccagtggcgaaggcgactatctgggcaaatactgacactgagacacgaaagcgtggggagcaaacagg

SEQ ID NO: 1806 - DNA, 253 bp, Unknown
  Description of Unknown: bacterium polynucleotide
  Gammaproteobacteria
tacagagggtgcaagcgttaatcggaatgactgggcgtaaagagtgcgtaggcggacagatgtgtcgcaggtgaaatccccgggcttaacctgggaaggtcctgcgaaactatgtgactagaatataggagagggaagtggaatttccggtgtagcggtgaaatgcgtagatatcggaaagaacaccagtggcgaaggcgacttcctggcctaatattgacgctgaggcacgaaagcgtggggagcaaacagg

SEQ ID NO: 1807 - DNA, 253 bp, Unknown
  Description of Unknown: bacterium polynucleotide
  Gammaproteobacteria
tacagagggtgcaagcgttaatcggaattactgggcgtaaagggcgtgtaggtggttttataagttggttgtgaaatccctgggcttaacctaggaatggcaatcaagactgtgagactagagtacggtagagggtagtggaatttccggtgtagcggtgaaatgcgtagagatcggaaggaacaccagtggcgaaggcggctacctggactgatactgacactgaggcgcgaaagcgtggggagcaaacagg

SEQ ID NO: 1808 - DNA, 253 bp, Unknown
  Description of Unknown: bacterium polynucleotide
  Gammaproteobacteria
tacagagggtgcgagcgttaatcggaattactgggcgtaaagggtgcgtaggtggttttgtaagttagatgtgaaattcctgggcttaacctggggactgcgtctgatactgcgaagctagagtactgtagagggaagtggaatttccggtgtagcagtgaaatgcgtagatatcggaaggaacatcagtggcgaaggcgacttcctggacagatactgacactgaggcacgaaagcgtggggagcaaacagg

SEQ ID NO: 1809 - DNA, 253 bp, Unknown
  Description of Unknown: bacterium polynucleotide
  Gammaproteobacteria
tacagagggcgcaagcgttaatcggaattattgggcgtaaagcgcacgtaggtggttgaataagtttgatgtgaaagccctgggcttaacctgggaattgcgttgaatactgtgcaacttgagtctggcagagggcggtggaatttccggtgtagcggtgaaatgcgtagagatcggaaagaacatcggtggcgaaggcggccgcctgggccaagactgacactgaggtgcgaaagcgtggggagcaaacagg

SEQ ID NO: 1810 - DNA, 253 bp, Unknown
  Description of Unknown: bacterium polynucleotide
  Gammaproteobacteria
tacagagggtgcaagcgttaatcggaattactgggcgtaaagggcgcgtaggcggttatttaagttaggtgtgaaattcctgggctcaacctaggagctgcacttaaaactgaatggctagagggtaaatagggaaaacggaattccaggtgtagcggtgaaatgcgtagatatctggaggaacaccggtggtgaagacggttttctgatttacaactgacgctgaggcgcgaaagcatggggagcaaacagg

SEQ ID NO: 1811 - DNA, 253 bp, Unknown
  Description of Unknown: bacterium polynucleotide
  Gammaproteobacteria
tacagagggtgcaagcgttaatcggaattactgggcgtaaagggtgcgtaggtggatacgtaagtcagatgtgaaatccccgggcttaacctgggaactgcatatgatactgcgaatctagagtatggtagaggtaagtggaatttccggtgtagcggtgaaatgcgtagatatcaagaggaacacctgaggtgaagacgggttgctaggctgacactgacgctgaggcgcgaaagccaggggagcaaacggg

SEQ ID NO: 1812 - DNA, 253 bp, Unknown
  Description of Unknown: bacterium polynucleotide
  Gammaproteobacteria
tacggagggtgcgagcgttagtcggattgactgggcgtaaagggcgtgtaggcggtgttgcaagcattttgtgaaagaacaaagcttaactttgtagagcaaaatggacggcatcactagagtctctgagaggggggtagaatttcaagtgtaacgttgaaatgtttagatatttgaaggaataccagtggcgaaggcggccccctggcagatgtactgacgctcagacgcgaaggcgcggggagcaaacagg

SEQ ID NO: 1813 - DNA, 253 bp, Unknown
  Description of Unknown: bacterium polynucleotide
  Gammaproteobacteria
aacgtaggacgcgagcgttatccggatttactgggcgtaaagcgcgcgtaggcggttgtggaagtcgggtgtgaaagccccgggcttaacctgggaattgcattcaatactccatggctagagtatggtagagggaagtggaatttccggtgtagcggtgaaatgcgtagatatcggaaggaacaccagtggcgaaagcgacttcctggaccaatactgacactcaggcgcgaaagcgtggggagcaaacagg

SEQ ID NO: 1814 - DNA, 253 bp, Unknown
  Description of Unknown: bacterium polynucleotide
  Gammaproteobacteria
tacggagggtgcaagcgttaatcggaattactgggcgtaaagcgcgcgtaggcggtttgataagtcgattgtgaaatccccgggctcaacctgggaattgcagtcgagactgtcagactagagtgtgggagagggtggtggaattcccggtgtagcggtgaaatgcgtagatatcgggaggaacatcagtggcgaaggcgaccgcctggcccaacactgacgctgaggtgcgaaagcgtgggtagcaaacagg

SEQ ID NO: 1815 - DNA, 253 bp, Unknown
  Description of Unknown: bacterium polynucleotide
  Gammaproteobacteria
tacagagggtgcgagcgttaatcggaattactgggggtaaagggtgcgtaggcggttatataagttagatgtgaaattcctgggcttaacctggggactgcgtctgatactgtatagctagagtactgtagaggaaggtggaatttccggtgtagcggtgaaatgcgtagatatcggaaggaacatcggtggcgaaggcgaccttctggacagtaactgacgctgaggcacgaaagcgtggggagcaaacagg

SEQ ID NO: 1816 - DNA, 253 bp, Unknown
  Description of Unknown: bacterium polynucleotide
  Gammaproteobacteria
tacagagggtgcaagcgttaatcggaattactgggcgtaaagggtgcgtaggtggtttagtaagttaggtgtgaaagtcctgggcttaacctggggattgcgcctaatactgctaggctagagtactgtagaggaaggtggaatttccggtgtagcggtgaaatgcgtagatatcggaaggaacatcagtggcgaaggcgactttctggacagatactgacactgaggcacgaaagcgtggggagcaaacagg

SEQ ID NO: 1817 - DNA, 253 bp, Unknown
  Description of Unknown: bacterium polynucleotide
  Gammaproteobacteria
tacagagggtgcgggcgttaatcggaattactgggcgtaaagggtgtgtaggtggttgtataagttagatgtgaaagccccgggctcaacctgggaacagcgtttaagactgtacgactagagtattgtagaggatagtggaatttccagtgtagcggtgaaatgcgtagatattggaaggaacaccagtggcgaaggcgactatctggacaaatactgacactgagacacgaaagcgtggggagcaaacagg

SEQ ID NO: 1818 - DNA, 253 bp, Unknown
  Description of Unknown: bacterium polynucleotide
  Gammaproteobacteria
tacagagggtgcgagcgttaatcggaattactgggcgtaaagggcgcgtaggcggctttgcaagacgatagtgaaatacctgggcttaacctggggacggctatcgtgactgtagggctagagtgcagtagagggtggaggaatttccggtgtagcggtgaaatgcgtagatatcggaaggaacaccagtggcgaaggcggccacctggactgacactgacgctgaggcgcgagagcgtggggagcaaacagg

SEQ ID NO: 1819 - DNA, 253 bp, Unknown
  Description of Unknown: bacterium polynucleotide
  Gammaproteobacteria
tacagagggtgcaagcgttaatcggaattattgggcgtaaagcgtgcgtaggtggtttaataagtttgatgtgaaagccctgggcttaacctgggaatggcgttgaagactgttaggcttgagtcggagagagggcagtggaatttctggtgtagcggtgaaatgcgtagagatcagaaagaacatcggtggcgaaggcggctgcctggctccagactgacactgaggcacgaaagcgtggggagcaaacagg

SEQ ID NO: 1820 - DNA, 253 bp, Unknown
  Description of Unknown: bacterium polynucleotide
  Gammaproteobacteria
tacgtagggtccaagcgttaatcggaattactgggcgtaaagggtgcgtaggtggttgaattagttaggtgtgaaagccccgggcttaacctgggaattgcgcctaatactgtttagctagagtactgtagaggaaggtggaatttccggtgtagcggtgaaatgcgtagatatcggaaggaacatcagtggcgaaggcgactttctggacagatactgacactgaggcacgaaagcatggggagcaaacagg

SEQ ID NO: 1821 - DNA, 253 bp, Unknown
  Description of Unknown: bacterium polynucleotide
  Gammaproteobacteria
tacggagggtgcaagcgttaatcggaattactgggcgtaaagagtgcgtaggtggttgcgtgtgttagatgtgaaatccatgggcttaacctgtgaattgcatttaaaactgcatgactagagtgttgtagagggtggcggaatttccagtgtagcggtgaaatgcgtagatattggaaggaacaccagtggcgaaggcggccacctggacaaacactgacactgaggcacgaaagcgtgggtagcgaacagg

SEQ ID NO: 1822 - DNA, 253 bp, Unknown
  Description of Unknown: bacterium polynucleotide
  Gammaproteobacteria
tacagagggtgcaagcgttaatcggaattactgggcgtaaagggcgcgtaggtggtttattaagtcagatgtgaaatccccgggcttaacctgggaattgcatatgaaactgattggctagagtatgagagagggaagtggaatttccggtgtagcggtgaaatgcgtagatatcggaaggaacatcagtggcgaaggcgacttcctggctcattactgacactgaggcgcgaaagcgtggggagcgaacagg

SEQ ID NO: 1823 - DNA, 253 bp, Unknown
  Description of Unknown: bacterium polynucleotide
  Gammaproteobacteria
tacggagggtgcaagcgttaatcggatttactgggcgtaaagcgcgcgtaggcggcttgttaagtcggatgtgaaagccctgggctcaacctaggaactgcattcgatactggcgagctagagtacgatagagggtggtagaattcctagtgtagcggtgaaatgcgtagatattaggaggaatgccggtggcgaaggcggccacctggatcgatactgacgctgaagtgcgaaagcgtggggagcaaacagg

SEQ ID NO: 1824 - DNA, 253 bp, Unknown
  Description of Unknown: bacterium polynucleotide
  Gammaproteobacteria
tacggagggtgcgagcgttaatcggaatgactgggcgtaaagggcatgtaggcggataattaagttaggtgtgaaagccctgggctcaacctaggaattgcacttaaaactggttaactagagtattgtagaggaaggtagaattccacgtgtagcggtgaaatgcgtagagatgtggaggaataccggtggcgaaggcggccttctggacagatactgacgctgagatgcgaaagcgtggggagcaaacagg

SEQ ID NO: 1825 - DNA, 253 bp, Unknown
  Description of Unknown: bacterium polynucleotide
  Gammaproteobacteria; Chromatiaceae
tacagagggtgcaagcgttaatcggaattactgggcgtaaagcgcacgtaggcggttagttaagttggatgtgaaagccccgggctcaacctgggaattgcattcaaaactggctaactagagtatgtgagaggggggtagaattccaagtgtagcggtgaaatgcgtagagatttggaggaataccagtggcgaaggcggccccctggcacaatactgacgctgaggtgcgaaagcgtggggagcaaacagg

SEQ ID NO: 1826 - DNA, 253 bp, Rheinheimera sp.
  Gammaproteobacteria; Chromatiaceae; Rheinheimera
tacagagggtgcaagcgttaatcggaattactgggcgtaaagcgcacgtaggcggttggttaagttggatgtgaaagccccgggctcaacctgggaattgcattcaaaactggccaactagaatacgggagaggggggtagaattccaagtgtagcggtgaaatgcgtagagatttggaggaataccagtggcgaaggcggccccctggcccgatattgacgctgaggtgcgaaagcgtggggagcaaacagg

SEQ ID NO: 1827 - DNA, 253 bp, Rheinheimera sp.
  Gammaproteobacteria; Chromatiaceae; Rheinheimera
tacagagggtgcaagcgttaatcggaattactgggcgtaaagcgcacgtaggcggttttttaagtcagatgtgaaagccccgggctcaacctgggaattgcatttgaagctggaaaactagagtgtgtgagaggggggtagaattccaagtgtagcggtgaaatgcgtagagatttggaggaataccagtggcgaaggcggccccctggcacaacactgacgctcaggtgcgaaagcgtggggagcaaacagg

SEQ ID NO: 1828 - DNA, 253 bp, Unknown
  Description of Unknown: bacterium polynucleotide
  Gammaproteobacteria; 211ds20
tacagagggtgcaagcgttaatcggaattactgggcgtaaagcgcgcgtaggcggctaattaagtcgggtgtgaaagccccgggctcaacctgggaattgcatccgatactgattggctagagtatgagagagggaggtagaattccacgtgtagcggtgaaatgcgtagatatgtggaggaataccggtggcgaaggcggcctcctggcttaatactgacgctgaggtgcgaaagcgtggggatcaaacagg

SEQ ID NO: 1829 - DNA, 253 bp, Unknown
  Description of Unknown: bacterium polynucleotide
  Gammaproteobacteria; 211ds20
tacagagggtgcaagcgttaatcggaattactgggcgtaaagcgcgcgtaggcggctgtctaagtcgggtgtgaaagccccgggctcaacctgggaactgcattcgatactggacggctagagtatgaaagagggaggtagaattccacgtgtagcggtgaaatgcgtagatatgtggaggaataccggtggcgaaggcggcctcctggcttaatactgacgctgaggtgcgaaagcgtggggatcaaacagg

SEQ ID NO: 1830 - DNA, 253 bp, Unknown
  Description of Unknown: bacterium polynucleotide
  Gammaproteobacteria; 211ds20
tacagagggtgcaagcgttaatcggaattactgggcgtaaagcgcgcgtaggcggctgcctaagtcggatgtgaaagccccgggctcaacctgggaactgcattcgatactgggcggctagagtatgagagagggaggtggaattccacgtgtagcggtgaaatgcgtagatatgcggaggaataccggtggcgaaggcggcctcctggttcaatactgacgctgaggtgcgaaagcgtggggagcaaacagg

SEQ ID NO: 1831 - DNA, 253 bp, Unknown
  Description of Unknown: bacterium polynucleotide
  Gammaproteobacteria; 211ds20
tacagagggtgcaagcgttaatcggaattactgggcgtaaagcgcgcgtaggcggctgattaagtcggatgtgaaatccccgggctcaacctgggaactgcactcgatactgatcggctagagtatgagagagggaggtagaattccacgtgtagcggtgaaatgcgtagatatgtggaggaataccggtggcgaaggcggcctcctggcttaatactgacgctgaggtgcgaaagcgtggggagcaaacagg

SEQ ID NO: 1832 - DNA, 253 bp, Unknown
  Description of Unknown: bacterium polynucleotide
  Gammaproteobacteria; Aeromonadaceae
tacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1833 - DNA, 253 bp, Tolumonas sp.
  Gammaproteobacteria; Aeromonadaceae; Tolumonas
tacggagggtgcaagcgttaatcggaataactgggcgtaaagcgcacgcaggcggttagataagtcagatgtgaaatccccgggctcaacctgggaactgcatttgaaactgtctgactagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1834 - DNA, 253 bp, Alcanivorax dieselolei
  Gammaproteobacteria; Alcanivoracaceae; Alcanivorax dieselolei
tacgaaaggtgcaagcgttaatcggaattactgggcgtaaagcgcgcgtaggcggtgtgttaagtcggatgtgaaagcccagggctcaaccttggaattgcatccgatactggcacgctagagtgcagtagagggaggtggaatttccggtgtagcggtgaaatgcgtagagatcggaaggaacaccagtggcgaaggcggcctcctggactgacactgacgctgaggtgcgaaagcgtggggagcaaacagg

SEQ ID NO: 1835 - DNA, 253 bp, Unknown
  Description of Unknown: bacterium polynucleotide
  Gammaproteobacteria; Alteromonadaceae
tacggagggtgcaagcgttaatcggaattactgggcgtaaagcgcgcgtaggcggccatttaagctagatgtgaaagcccagggcttaaccttggaactgcatttagaactggatggctagagtatggaagaggagtgtggaatttcaggtgtagcggtgaaatgcgtagagatctgaaggaacatcagtggcgaaggcgacactctggtccaatactgacgctgaggtgcgaaagcgtggggatcaaacagg

SEQ ID NO: 1836 - DNA, 253 bp, Unknown
  Description of Unknown: bacterium polynucleotide
  Gammaproteobacteria; Alteromonadaceae
tacggagggtgcgagcgttaatcggaattactgggcgtaaagcgcacgtaggcggtttgttaagctggatgtgaaagccccgggctcaacctgggaattgcactcagaactggcagactagagtacggtagaggtgagtggaatttcctgtgtagcggtgaaatgcgtagatataggaaggaacatcagtggcgaaggcgactcactggactgatactgacgctgaggtgcgaaagcgtggggagcaaacagg

SEQ ID NO: 1837 - DNA, 253 bp, Cellvibrio sp.
  Gammaproteobacteria; Alteromonadaceae; Cellvibrio
tacggagggtgcaagcgttaatcggaattactgggcgtaaagcgcacgtaggtggtttgttaagctagctgtgaaatccccgggctcaacctgggcactgcagttagaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1838 - DNA, 253 bp, Cellvibrio sp.
  Gammaproteobacteria; Alteromonadaceae; Cellvibrio
tacggggggggcaagcgttgttcggaattactgggcgtaaagcgcacgtaggtggtttgttaagtcagctgtgaaatccccgggctcaacctgggcactgcagttgaaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1839 - DNA, 253 bp, Cellvibrio sp.
  Gammaproteobacteria; Alteromonadaceae; Cellvibrio
tacggagggtgcaagcgttaatcggaattactgggcgtaaagcgcacgtaggtggttcgctaagtcagctgtgaaatccccgggctcaacctgggacttgcagttgaaactggtgagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1840 - DNA, 253 bp, Cellvibrio sp.
  Gammaproteobacteria; Alteromonadaceae; Cellvibrio
tacggagggtgcaagcgttaatcggaattactgggcgtaaagcgcacgtaggcggttcgttaagccagctgtgaaatccccgggctcaacctgggaattgcagttggaactggcgagctagagtatggtagaggggtgtggaatttcaggtgtagcggtgaaatgcgtagatatctgaaggaacaccagtggcgaaggcgacaccctggaccaatactgacgctgaggtgcgaaagcgtggggagcaaacagg

SEQ ID NO: 1841 - DNA, 253 bp, Unknown
  Description of Unknown: bacterium polynucleotide
  Gammaproteobacteria; Coxiellaceae
tacagagggtgcaagcgttaatcggagttactgggcgtaaagggcgcgtaggtggttgtgtaagtgagacgtgaaagccccgggcttaacctgggaatgtcgtcttaaactgcatgactggagtactgtagagggtagtggaatttccggtgtagcggtgaaatgcgtagagatcggaaggaacaccagtggcgaaggcggctacctggacaaatactgacgctgatgcgcgagagcgtggggagcaaacagg

SEQ ID NO: 1842 - DNA, 253 bp, Unknown
  Description of Unknown: bacterium polynucleotide
  Gammaproteobacteria; Coxiellaceae
tacagagggtgcaagcgttaatcggaattactgggcgtaaagggcgcgtaggcggttaattaagttagatgtgaaattcctgggcttaaccgaggactgacatttgatactggttgactagagtgcggtagagggtagtggaatttccggtgtagcggtgaaatgcgtagatatcggaaggaacaccggtggcgaaggcggctacctggactgacactgacgctgaggcgcgaaagcgtggggagcaaacagg

SEQ ID NO: 1843 - DNA, 253 bp, Unknown
  Description of Unknown: bacterium polynucleotide
  Gammaproteobacteria; Coxiellaceae
tacagagggtgcaagcgttaatcggagttactgggcgtaaagggcgcgtaggcggttatgtaagtgagatgtgaaagccctgggcttaacctaggaactgcatcttatactgcataactggagtactgtagagggtagtggaatttccggtgtagcggtgaaatgcgtagagatcggaaggaacaccagtggcgaaggcggctacctggacagatgctgacgctgaggcgcgagagcgtggggagcaaacagg

SEQ ID NO: 1844 - DNA, 253 bp, Unknown
  Description of Unknown: bacterium polynucleotide
  Gammaproteobacteria; Coxiellaceae
tacagagggtgcgagcgttaatcggaattactgggcgtaaagggcgcgtaggcggttagataagtgagatgtgaaatccctgggcttaacctaggaactgcatcttatactgtttagcttgagtgcagtagagggtagtggaatttccggtgtagcggtgaaatgcgtagatatcggaaggaacaccagtggcgaaggcggctacctggactgacactgacgctgaggcgcgagagcgtggggagcaaacagg

SEQ ID NO: 1845 - DNA, 253 bp, Unknown
  Description of Unknown: bacterium polynucleotide
  Gammaproteobacteria; Coxiellaceae
tacagagagtgcgagcgttaatcggaattactgggcgtaaagcgcacgtaggtggattcttaagtcagatgtgaaagccccgagcttaacttgggaattgcatttgatactgggcgtctagaatatagtagagggaagtggaatttccggtgtagcggtgaaatgcgtagatatcggaaggaacatcagtggcgaaagcggcttcctggactaatattgacacttaggtgcgaaagcgtggggagcaaacagg

SEQ ID NO: 1846 - DNA, 253 bp, Unknown
  Description of Unknown: bacterium polynucleotide
  Gammaproteobacteria; Coxiellaceae
tacagagggtgcaagcgttagtcggaattattgggcgtaaagcgcatgtaggtggttgtataagtttgatgtgaaagccctgggcttaacctgggaattgcgttgaatactgtgcaacttgagtcggacagagggcggtggaatttccggtgtagcggtgaaatgcgcagagatcggaaagaacatcggtggcgaaggcggccgcctgggtccagactgacactgaggtgcgaaagcgtggggagcaaacagg

SEQ ID NO: 1847 - DNA, 253 bp, Unknown
  Description of Unknown: bacterium polynucleotide
  Gammaproteobacteria; Coxiellaceae
tacagagggtgcaagcgttaatcggatttattgggcgtaaagggcgcgtaggtggtaaagcaagtaggatgtgaaagccctgggcttaacctgggaagtgcatcctaaactgcttaactagagtatggtagagggtagtggaatttccggtgtagcggtgaaatgcgtagagatcggaaggaacgccagtggtgaagacgactacctggaccaatactgacactgaggcgcgaaagcgtggggatcaaacagg

SEQ ID NO: 1848 - DNA, 253 bp, Unknown
  Description of Unknown: bacterium polynucleotide
  Gammaproteobacteria; Coxiellaceae
tacagagggtgcaagcgttaatcggagttactgggcgtaaagggcgcgtaggcggtcatttaagtttgatgtgaaatccctgggcttaacctaggaactgcattgaaaactgggtgactggagtactgtagagggtagtggaatttccggtgtagcggtgaaatgcgtagagatcggaaggaacaccagtggcgaaggcggctacctggacagatactgacgctgaggcgcgagagcgtggggagcaaacagg

SEQ ID NO: 1849 - DNA, 253 bp, Unknown
  Description of Unknown: bacterium polynucleotide
  Gammaproteobacteria; Coxiellaceae
tacagagggtgcaagcgttaatcggatttactgggcgtaaagggcgcgtaggtggtagcgtaagtgagatgtgaaatccccgggcttaacctgggacgtgcatcttagactgcgtaacttgagtgtagtagagggtagtggaatttccggtgtagcggtgaaatgcgtagatatcggaaggaacaccagtggcgaaggcggctacctggactaacactgacactgaggcgcgagagcgtggggagcaaacagg

SEQ ID NO: 1850 - DNA, 253 bp, Unknown
  Description of Unknown: bacterium polynucleotide
  Gammaproteobacteria; Coxiellaceae
tacagagggtgcgagcgttaatcggagttactgggcgtaaagggcgcgtaggcggttatataagattgatgtgaaatccctgggcttaacctaggaactgcattgattactgtatgactggagtactgtagagggtagtagaatttccggtgtagcggtgaaatgcgtagagatcggaaggaataccagtggcgaaggcggctacctggacagatactgacgctgaggcgcgagagcgtggggagcaaacagg

SEQ ID NO: 1851 - DNA, 253 bp, Unknown
  Description of Unknown: bacterium polynucleotide
  Gammaproteobacteria; Coxiellaceae
tacagagggtgcgagcgttaatcggaattactgggcgtaaagggcgcgtaggtggttatgtaagattgatgtgaaatccctgggcttaacctaggaactgcatcgatgactgcatagctggagtactgtagagggtagtagaatttccggtgtagcggtgaaatgcgtagagatcggaaggaataccagtggcgaaggcggctacctggacagatactgacactgaggcgcgaaagcgtggggagcaaacagg

SEQ ID NO: 1852 - DNA, 253 bp, Unknown
  Description of Unknown: bacterium polynucleotide
  Gammaproteobacteria; Coxiellaceae
tacagagggtgcgagcgttaatcggaattactgggcgtaaagggcgcgtaggcggctatataagttagatgtgaaattcttgggcttaacctgagcattgcatttaatactgtatggctagagtagagtagagggaagtggaatttccggtgtagcggtgaaatgcgtagatatcggaaagaacatcagtggcgaaggcggctttctggactcatactgacgctgaggcgcgaaagcatgggtagcaaacagg

SEQ ID NO: 1853 - DNA, 253 bp, Unknown
  Description of Unknown: bacterium polynucleotide
  Gammaproteobacteria; Coxiellaceae
tacagagggtgcaagcgttaatcggagttactgggcgtaaagggcgcgtaggtggttgtttaagtgagatgtgaaagccctgggcttaacctaggaactgcatcttatactgggcaactggagtactgtagagggtagtggaatttccggtgtagcggtgaaatgcgtagagatcggaaggaacaccagtggcgaaggcggctacctggacagatactgacactgaggcgcgagagcgtggggagcaaacagg

SEQ ID NO: 1854 - DNA, 253 bp, Unknown
  Description of Unknown: bacterium polynucleotide
  Gammaproteobacteria; Coxiellaceae
tacagagggtgcaagcattaatcggatttactgggcgtaaagggcgcgtaggcggtgatgtaagtgagatgtgaaatccctgggcttaacctaggacctgcatctcatactgcatagctagagtattgtagagggtagtggaatttccggtgtagcggtgaaatgcgtagagatcggaaggaacaccagtggcgaaggcggctacctggacaaatactgacgctgatgcgcgagagcgtggggagcaaacagg

SEQ ID NO: 1855 - DNA, 253 bp, Unknown
  Description of Unknown: bacterium polynucleotide
  Gammaproteobacteria; Coxiellaceae
tacagagggtgcaagcgctaatcggaattactgggcgtaaagggcgcgtaggcggttatgtaagtgagatgtgaaatccctgggcttaacctaggaactgcatctcatactgtgtaactagagtattgtagagggtagtggaatttccggtgtagcggtgaaatgcgtagagatcggaaggaacaccagtggcgaaggcggctacctggacaaatactgacgctgaggcgcgagagcgtggggagcaaacagg

SEQ ID NO: 1856 - DNA, 253 bp, Unknown
  Description of Unknown: bacterium polynucleotide
  Gammaproteobacteria; Coxiellaceae
tacggagggtgcgagcgttaatcggaattactgggcgtaaagggcgcgttggtggtttgttaagattgttgtgaaatccctgggcttaacctaggaactgcaacgatgactgataagcttgagtattgtagagggtagtggaatttccggtgtagcggtgaaatgcgtagagatcggaaggaacaccagtggcgaaggcggctacctggacaaatactgacactgaggcgcgagagcgtggggagcaaacagg

SEQ ID NO: 1857 - DNA, 253 bp, Unknown
  Description of Unknown: bacterium polynucleotide
  Gammaproteobacteria; Coxiellaceae
tacagagggtgcaagcgttaatcggagttactgggcgtaaagggcgcgtaggttgttgtttaagtttgatgtgaaagccctgggcttaacctaggaactgcattgaatactgggcgactagagtactgtagagggtagtggaatttccggtgtagcggtgaaatgcgtagagatcggaaggaacaccagtggcgaaggcggctacctggacagatactgacactgaggcgcgagagcgtggggagcaaacagg

SEQ ID NO: 1858 - DNA, 253 bp, Unknown
  Description of Unknown: bacterium polynucleotide
  Gammaproteobacteria; Coxiellaceae
tacagagggtgcaagcgttaatcggagttactgggcgtaaagggcgcgtaggttgatatgtaagtgagttgtgaaatccctgggcttaacctaggaactgcaacttatactgtgtatctagagtactgtagagggtagtggaatttccggtgtagcggtgaaatgcgtagagatcggaaggaacaccagtggcgaaggcggctacctggacagatactgacactgaggcgcgagagcgtgggtagcaaacagg

SEQ ID NO: 1859 - DNA, 253 bp, Unknown
  Description of Unknown: bacterium polynucleotide
  Gammaproteobacteria; Coxiellaceae
tacagagggtgcgagcgttaatcggagttactgggcgtaaagggcgcgtaggcggttgaataagatgtgtgtgaaaaccctgggcttaacctgggacgtgcatacaagactgtttgactagagtacagtagagggtagtggaatttccggtgtagcggtgaaatgcgtagatatcggaaggaacaccggtggcgaaggcggctacctgggctgatactgacgctgaggcgcgagagcgtggggagcaaacagg

SEQ ID NO: 1860 - DNA, 253 bp, Unknown
  Description of Unknown: bacterium polynucleotide
  Gammaproteobacteria; Coxiellaceae
tacagagggtgcgagcgttaatcggaattactgggcgtaaagggcgcgtaggcggtctatcaagtgagatgtgaaatccccgggcttaacctgggaactgcatcttaaactgatgggctggagtactgtagaggatagtggaatttccggtgcagcggtgaaatgcgtagagatcggaaggaacatcagtggcgaaggcgactgtctggacagatactgacgctgaggcgcgaaagcgtggggagcaaacagg

SEQ ID NO: 1861 - DNA, 253 bp, Unknown
  Description of Unknown: bacterium polynucleotide
  Gammaproteobacteria; Coxiellaceae
tacagagggtgcgagcgttaatcggaattactgggcgtaaagggcgcgtaggtggtttgttaagattgatgtgaaatccctgggcttaacctaggaactgcatcgatgactgacaagcttgagtactgtagagggtagtggaatttccggtgtagcggtgaaatgcgtagagatcggaaggaacactagtggcgaaggcggctacctggacagatactgacactgaggcgcgagagcgtggggagcaaacagg

SEQ ID NO: 1862 - DNA, 253 bp, Unknown
  Description of Unknown: bacterium polynucleotide
  Gammaproteobacteria; Coxiellaceae
tacagagggtgcgagcgttaatcggagttactgggcgtaaagggcgcgtaggcggattattaagtgagatgtgaaatccctgggcttaacctaggaactgcgtctcatactggtagtctagagtattgtagagggtagtggaatttccggtgtagcggtgaaatgcgtagagatcggaaggaacaccagtggcgaaggcggctacctggacaaatactgacgctgaggcgcgaaagcgtggggagcaaacagg

SEQ ID NO: 1863 - DNA, 253 bp, Unknown
  Description of Unknown: bacterium polynucleotide
  Gammaproteobacteria; Coxiellaceae
tacggagggtgcaagcattaatcggatttattgggcgtaaagggcgcgtaggcggtagatttagtgagatgtgaaagccctgggcttaacctaggaaccgcatcttatactgatctgctagagtattgtagagggtagtggaatttccggtgtagcggtgaaatgcgtagagatcggaaggaacaccagtggcgaaggcggctacctggacaaatactgacgctgaggcgcgaaagcgtggggagcaaacagg

SEQ ID NO: 1864 - DNA, 253 bp, Unknown
  Description of Unknown: bacterium polynucleotide
  Gammaproteobacteria; Coxiellaceae
tacagagggtgcgagcgttaatcggagttactgggcgtaaagggcgcgtaggcggttctataagtgagatgtgaaaggcctgggcttaacctaggaacggcatcttagactataggactagagtgcagtagagggtggcggaatttccggtgtagcggtgaaatgcgtagagatcggaaggaacaccagtggcgaaggcggccacctggactgtcactgacgctgaggcgcgagagcgtgggtagcaaacagg

SEQ ID NO: 1865 - DNA, 253 bp, Unknown
  Description of Unknown: bacterium polynucleotide
  Gammaproteobacteria; Coxiellaceae
tacagagggtgcgagcgttaatcggagttactgggcgtaaagggcgcgtaggcggttatttgagttggatgtgaaatccctgggcttaacctaggaactgcattcgaaactggatgactggagtactgtagagggtagtggaatttccggtgtagcggtgaaatgcgtagagatcggaaggaacaccagtggcgaaggcggctacctggacagatactgacactgaggcgcgaaagcgtggggatcaaacagg

SEQ ID NO: 1866 - DNA, 253 bp, Unknown
  Description of Unknown: bacterium polynucleotide
  Gammaproteobacteria; Coxiellaceae
tacagaaggtgctagcgttaatcggatttattgggcgtaaagggcgcgtaggtggtaaagcaagtaagatgtgaaagccctgggcttaacctgggaagtgcatcttaaactgcttaactagagtatggtagagggtagtggaatttctggtgtagcggtgaaatgcgtagatatcggaaggaacgccagtggtgaagacgactacctggaccaatactgacactgaggcgcgagagcgtggggagcaaacagg

SEQ ID NO: 1867 - DNA, 252 bp, Unknown
  Description of Unknown: bacterium polynucleotide
  Gammaproteobacteria; Coxiellaceae
tacagagggtgcgagcgttaatcggaattactgggcgtaaagggcgcgtaggcggatatttaagttagatgtgaaatccctggcttaacctaggaactgcatctaagactggctatctggagtgcggtagaggatagtggaatttccggtgtagcggtgaaatgcgtagatatcggaaggaacaccagtggcgaaggcggctatctggactgacactgacgctgaggcgcgagagcgtggggagcaaacagg

SEQ ID NO: 1868 - DNA, 253 bp, Unknown
  Description of Unknown: bacterium polynucleotide
  Gammaproteobacteria; Coxiellaceae
tacagagggtgcaagcgttaatcggaattactgggcgtaaagcgcgcgtaggtggatatttaagtcggatgtgaaatccccgggctcaacctgggaactgcattcgatactggatatctagagtatggtagaggaaagtggaattcccggtgtagcggtgaaatgcgtagatatcgggaggaacaccagtggcgaaggcggctttctggaccaatactgacactgaggcgcgaaagcgtggggagcaagcagg

SEQ ID NO: 1869 - DNA, 253 bp, Unknown
  Description of Unknown: bacterium polynucleotide
  Gammaproteobacteria; Coxiellaceae
tacagagggtgcgagcgttaatcggagttactgggcgtaaagggcgcgtaggcggttgtttaagtgagatgtgaaatccctgggcttaacctaggaactgcatctcatactggacagctagagtattgtagagggtagtggaatttccggtgtagcggtgaaatgcgtagagatcggaaggaacaccagtggcgaaggcggctacctggacaaatactgacgctgaggcgcgaaagcgtggggagcaaacagg

SEQ ID NO: 1870 - DNA, 253 bp, Unknown
  Description of Unknown: bacterium polynucleotide
  Gammaproteobacteria; Coxiellaceae
tacagagggtgcaagcgttaatcggaatgattgggcgtaaagcgcatgtaggtggtttgttaagtttgatgtgaaagccctgggcttaacctgggaatggcgttgaagactggcagactggagtcggacagagggtcgtggaatttccggtgtagcggtgaaatgcgtagagatcggaaagaatatcgatggcgaaggcagcgacctgggaccagactgacactgaggtgcgaaagcatggggagcaaacagg

SEQ ID NO: 1871 - DNA, 253 bp, Unknown
  Description of Unknown: bacterium polynucleotide
  Gammaproteobacteria; Coxiellaceae
tacagagggtgcaagcgttaatcggaattactaggcgtaaagggcgtgtaggtggttgtgtaagttggttgtgaaatccctgggcttaacctaggaatggcaatcaagactgcataactagagtacggtagagggtagtggaatttccggtgtagcggtgaaatgcgtagagatcggaaggaacaccagtggcgaaggcggctacctggactgatactgacactgaggcgcgagagcgtggggagcaaacagg

SEQ ID NO: 1872 - DNA, 253 bp, Unknown
  Description of Unknown: bacterium polynucleotide
  Gammaproteobacteria; Coxiellaceae
tacagagggtgcaagcgttaatcggaattactgggcgtaaagggcgcgtaggtggtcttgtaagtgagatgtgaaatccccgggcttaacctgggacgtgcatcttatactgtgagactggagtacaagagagggtagtggaatttccggtgtagcggtgaaatgcgtagatatcggaaggaacaccagtggcgaaggcggctacctggcttgatactgacactgaggcgcgagagcgtggggagcaaacagg

SEQ ID NO: 1873 - DNA, 253 bp, Unknown
  Description of Unknown: bacterium polynucleotide
  Gammaproteobacteria; Coxiellaceae
tacagagggtgcaagcgttaatcggaattactgggcgtaaagggcgcgtaggtggttagataagtgagttgtgaaatccctgggcttaacctaggaactgcaacttatactgtttgactagagtattgtagagggtagtggaatttccggtgtagcggtgaaatgcgtagatatcggaaggaacatcagtggcgaaggcgactacctggacaaatactgacactgaggcgcgaaagcgtggggagcaaacagg

SEQ ID NO: 1874 - DNA, 253 bp, Unknown
  Description of Unknown: bacterium polynucleotide
  Gammaproteobacteria; Coxiellaceae
tacagagggtgcgagcgttaatcggaattactgggcgtaaagggcgcgtaggcggttatttaagttggatgtgaaatccctgggcttaacctaggaactgcaaccaatactggatagctagagtgcagtagagggtagtggaatttccggtgtagcggtgaaatgcgtagatatcggaaggaacaccagtggcgaaggcggctacctggactgacactgacgctgaggcgcgagagcgtggggagcaaacagg

SEQ ID NO: 1875 - DNA, 253 bp, Unknown
  Description of Unknown: bacterium polynucleotide
  Gammaproteobacteria; Coxiellaceae
tacagagggtgcgagcgttaatcggaatgactgggcgtaaagggcgcgtaggcggttttttaagatggttgtgaaatccctgggcttaacctaggaatggcaaccatgactggaaagctggagtactgtagagggtagtggaatttccggtgtagcggtgaaatgcgtagagatcggaaggaacaccagtggcgaaggcggctacctggacagatactgacgctgaggcgcgagagcgtggggagcaaacagg

SEQ ID NO: 1876 - DNA, 253 bp, Unknown
  Description of Unknown: bacterium polynucleotide
  Gammaproteobacteria; Coxiellaceae
tacagagggtgcaagcgttaatcggatttactgggcgtaaagggcgcgtaggtggaagcgtaagtgagatgtgaaatccccgggcttaacctgggaactgcatcttatactgcgtatctggagtgcgatagagggtagtggaatttccggtgtagcggtgaaatgcgtagatatcggaaggaacaccagtggcgaaggcggctacctggatcgacactgacactgaggcgcgagagcgtggggagcaaacagg

SEQ ID NO: 1877 - DNA, 253 bp, Unknown
  Description of Unknown: bacterium polynucleotide
  Gammaproteobacteria; Coxiellaceae
tacagagggtgcaagcgttaatcggaattactgggcgtaaagggcgcgtaggttgttatttaagtgagatgtgaaatccccgggcttaacctgggaactgcatcttatactgggtatctcgagtgtggtagagggaagtggaatttccggtgtagcggtgaaatgcgtagagatcggaaggaacgtcgatggcgaaggcagccacctggctagatactgacgctgaggcgcgaaagcgtgggtagcgaacagg

SEQ ID NO: 1878 - DNA, 253 bp, Unknown
  Description of Unknown: bacterium polynucleotide
  Gammaproteobacteria; Coxiellaceae
tacagagggtgcgagcgttaatcggaattactgggcgtaaagggcgcgtaggcggttatgtaagttagatgtgaaatccctgggcttaacctaggaactgcatctaagactgtatagctagagtgcagtagagggtagtggaatttccggtgtagcggtgaaatgcgtagatatcggaaggaacaccagtggcgaaggcggctacctggactgacactgtcgctgaggcgcgagagcgtagggagcaaacagg

SEQ ID NO: 1879 - DNA, 253 bp, Unknown
  Description of Unknown: bacterium polynucleotide
  Gammaproteobacteria; Coxiellaceae
tacagagggtgcaagcgttaatcggatttactgggcgtaaagggcgcgtaggtggttacgtaagtgagatgtgaaatccccgggcttaacctgggaactgcatcttatactgcgtagctggagtacattagagggtagtggaatttccggtgtagcggtgaaatgcgtagatatcggaaggaacaccagtggcgaaggcggctacctgaaatgatactgacactgaggcgcgagagcgtggggagcaaacagg

SEQ ID NO: 1880 - DNA, 253 bp, Unknown
  Description of Unknown: bacterium polynucleotide
  Gammaproteobacteria; Coxiellaceae
tacagagggtgcgagcgttaatcggatttactgggcgtaaagggcgcgtaggtggttagttaagatagctgtgaaatccctgggcttaacctaggaacggcagctgtgactggctagctagagtactgtagagggtagtggaatttccggtgtagcggtgaaacgcgtagagatcggaaggaacaccagtggcgaaggcggctacctggacagatactgacgctgaggcgcgagagcgtggggagcaaacagg

SEQ ID NO: 1881 - DNA, 253 bp, Unknown
  Description of Unknown: bacterium polynucleotide
  Gammaproteobacteria; Coxiellaceae
tacagagggtgcaagcgttaatcggagttactgggcgtaaagggcgcgtaggcggttgattaagtgagatgtgaaagccccgggcttaacctgggaacggcatcttaaactggttgactggagtactgtagagggtagtggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1882 - DNA, 253 bp, Unknown
  Description of Unknown: bacterium polynucleotide
  Gammaproteobacteria; Coxiellaceae
tacagagggtgcaagcgttaatcggaattactgggcgtaaagggcgcgcaggcggttaattaagttggatgtgaaacccctgggctcaacctaggaactgcatccgatactggttagctagagtgcggtagagggtagtggaatttccggtgtagcggtgaaatgcgtagatatcggaaggaacaccagtggcgaaggcggctacctggactgacactgacgctgaggcgcgagagcgtggggagcaaacagg

SEQ ID NO: 1883 - DNA, 253 bp, Unknown
  Description of Unknown: bacterium polynucleotide
  Gammaproteobacteria; Coxiellaceae
tacagggagtgcaagcgttaatcggaattactgggcgtaaagcgcgcgtaggtggatacttaagtcagatgtgaaatccctgggcttaacctaggaattgcatctgatactgggtatctcgagtgtggtagagggaagtggaatttccggtgtagcggtgaaatgcgtagatatcggaaagaacaccagtggcgaaggcggcttcctggaccaacactgacactgaggcgcgaaagcgtggggagcaaacagg

SEQ ID NO: 1884 - DNA, 253 bp, Unknown
  Description of Unknown: bacterium polynucleotide
  Gammaproteobacteria; Coxiellaceae
tacagagggtgcaagcgttaatcggagttactgggcgtaaagggcgcgtaggtgggtgcataagtgagttgtgaaatccctgggcttaacctaggaactgcaacttatactgtgttccttgagtactgtagagggtagtggaatttccggtgtagcggtgaaatgcgtagagatcggaaggaacaccagtggcgaaggcggctacctggacagatactgacactgaggcgcgagagcgtgggtagcaaacagg

SEQ ID NO: 1885 - DNA, 253 bp, Unknown
  Description of Unknown: bacterium polynucleotide
  Gammaproteobacteria; Coxiellaceae
tacgtagggggcgagcgttgtccggagttactgggcgtaaagggcgcgtaggcggttatataagttgtgtgtgaaatctctgggcttaacctgggaactgcacatgatactgtatggctagagtagagtagaggaaagtggaatttccggtgtagcggtgaaatgcgtagatatcggaaggaacaccagtggcgaaggcggctttctggactcatactgacgctgaggcgcgaaagcgtggggagcaaacagg

SEQ ID NO: 1886 - DNA, 253 bp, Aquicella sp.
  Gammaproteobacteria; Coxiellaceae; Aquicella
tacagagggtgcgagcgttaatcggagttactgggcgtaaagggcgcgtaggcggtaatatgagtgtggtgtgaaagccccgggcttaacctgggaagtgcatcgcaaacgatataactagagtagatgagagggtggcggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1887 - DNA, 253 bp, Aquicella sp.
  Gammaproteobacteria; Coxiellaceae; Aquicella
tacagagggtgcaagcgttgatcggaattactgggtgtaaagggcgcgtaggcggtgagatgagtgtggtgtgaaagccccgggcttaacctgggaagtgcatcgcaaacgatctgactagagtatatgagagggtggcggaatttccggtgtagcggtgaaatgcgtagagatcggaaggaacgtcgatggcgaaggcagccacctggcataatactgacgctgaggcgcgaaagcgtggggagcgaacagg

SEQ ID NO: 1888 - DNA, 253 bp, Aquicella sp.
  Gammaproteobacteria; Coxiellaceae; Aquicella
tacagagggtgcgagcgttaatcggagtaactgggcgtaaagggcgcgtaggcggtctcaagagtgtgatgtgaaagccccgggcttaacctgggaagtgcatcgcaaacgctgagactggagtataggagagggtggcggaatttccggtgtagcggtgaaatgcgtagagatcggaaggaacgtcgatggcgaaggcagccacctggcctaatacagacgctgaggcgcgaaagcgtgggtagcgaacagg

SEQ ID NO: 1889 - DNA, 253 bp, Aquicella sp.
  Gammaproteobacteria; Coxiellaceae; Aquicella
tacggagggtgcaagcattgatcggaattactgggcgtaaagggcgcgtaggcggtaagataagtcggatgtgaaagccccgggcttaacctgggaagtgcatcgcaaacgatttgactggagtagatgagagggtggtgggatttccggtgtagcggtgaaatgcgtagagatcggaaggaacgtcaatggcgaaggcagccacctggcatcatactgacgctgaggcgcgaaagcgcggggagcgaacagg

SEQ ID NO: 1890 - DNA, 253 bp, Aquicella sp.
  Gammaproteobacteria; Coxiellaceae; Aquicella
tacagagggtgcgagcgttaatcggaattactgggcgtaaagggcgcgtaggcggagtaatgagtgtgatgtgaaagccctgggcttaacctgggaagtgcatcgcaaacgattgctctggaatacaagagagggtggcggaatttccggtgtagcggtgaaatgcgtagagatcggaaggaacgccgatggcgaaggcagccacctggcttgatattgacgctgaggcgcgaaagcgtggggagcgaacagg

SEQ ID NO: 1891 - DNA, 253 bp, Aquicella sp.
  Gammaproteobacteria; Coxiellaceae; Aquicella
tacagagggtgcgagcgttaatcggaattactgggcgtaaagggcgcgtaggcggttagttaagtgtgatgtgaaagccccgggcttaacctgggaagtgcatcgcaaactggttaactggagtatatgagagggtggcggaatttccggtgtagcggtgaaatgcgtagagatcggaaggaacgtcgatggcgaaggcagccacctggcataatactgacgctgatgcgcgaaagcgtggggagcgaacagg

SEQ ID NO: 1892 - DNA, 253 bp, Aquicella sp.
  Gammaproteobacteria; Coxiellaceae; Aquicella
tacagagggtgcgagcgttaatcggaattactgggtgtaaagggcgcgtaggcggcgagatgtgtgtggtgtgaaagccccgggcttaacctgggaagtgcatcgcaaactggtttgctagagtatatgagagggtggcggaatttccggtgtagcggtgaaatgcgtagagatcgggaggaacgtcaatggcgaaggcagccacctggcataatactgacgctgaggcgcgaaagcgtggggagcgaacagg

SEQ ID NO: 1893 - DNA, 253 bp, Aquicella sp.
  Gammaproteobacteria; Coxiellaceae; Aquicella
tacagagggtgctagcgttaatcggaattactgggcgtaaagggcgcgcaggcggtcatgcgagtgtgatgtgaaagccccgggcttaacctgggaagtgcatcgcaaacggcatgactggagtagatgagagggtggcggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1894 - DNA, 253 bp, Aquicella sp.
  Gammaproteobacteria; Coxiellaceae; Aquicella
tacagagggtgcgagcgttaatcggagttactgggcgtaaagggcgcgtaggcggtgagatgtgtgtgatgtgaaagccccgggcttaacctgggaagtgcatcgcaaactgtttgactagagtagatgagagggtgatggaatttccggtgtagcggtgaaatgcgtagagatcggaaggaacgtcaatggcgaaggcagtcacctggcatcatactgacgctgaggcgcgaaagcgtggggagcgaacagg

SEQ ID NO: 1895 - DNA, 253 bp, Aquicella sp.
  Gammaproteobacteria; Coxiellaceae; Aquicella
tacgtggggtccaagcgttaatcggaattactgggcgtaaagggcgcgtaggcggttaaatgagtgtgatgtgaaagccccgggctcaacctgggaagtgcatcgcaaacgatttaactggagtagatgagagggtggtggaatttccggtgtagcggtgaaatgcgtagagatcggaaggaacgtcaatggcgaaggcagccacccggcatcatactgacgctgaggcgcgaaagcgtggggagcaaacagg

SEQ ID NO: 1896 - DNA, 253 bp, Aquicella sp.
  Gammaproteobacteria; Coxiellaceae; Aquicella
tacagagggtgcgagcgttaatcggaattactgggcgtaaagggcgcgtaggcggtgtaatgtgagtgatgtgaaagccccgggcttaacctgggaagcgcatcgcagactattagactagagtatatgagagggtggcggaatttccggtgtagcggtgaaatgcgtagagatcggaaggagcgtcgatggcgaaggcagccacctggcataatactgacgctgaggcgcgaaagcgtgggtagcgaacagg

SEQ ID NO: 1897 - DNA, 253 bp, Aquicella sp.
  Gammaproteobacteria; Coxiellaceae; Aquicella
tacagagggtgcgagcgttaatcggaattactgggtgtaaagggcgcgtaggcggtaagatgtgtgtgttgtgaaagctccgggcttaacctgggaagagcaatgcaaactatctaactagagtatatgagagggtggcggaatttccggtgtagcggtgaaatgcgtagagatcggaaggaacgtcaatggcgaaggcagccacctggcataatactgacgctgaggcgcgaaagcgtggggagcgaacagg

SEQ ID NO: 1898 - DNA, 253 bp, Aquicella sp.
  Gammaproteobacteria; Coxiellaceae; Aquicella
tacagagggtgcgagcgttaatcggatttactgggcgtaaagggcgcgtaggcggttgtgtgagtgtgatgtgaaagccccgggcttaacctgggaagtgcatcgcaaacgacataactggagtaggtgagagggtggcggaatttccggtgtagcggtgaaatgcgtagagatcggaaggaacgtcaatggcgaaggcagccacctggcaccatactgacgctgaggcgcgaaagcgtggggagcgaacagg

SEQ ID NO: 1899 - DNA, 253 bp, Aquicella sp.
  Gammaproteobacteria; Coxiellaceae; Aquicella
tacagagggtgcaagcgttaatcggagttactgggcgtaaagggcgcgtaggcggtttagtgggtgtgatgtgaaagccccgagcttaacttgggaagtgcatcgcaaactgttgaactggagtacaagagagggtggcggaatttccggtgtagcggtgaaatgcgtagagatcggaaggaacgtcaatggcgaaggcagccacctggcttgatactgacgctgaggcgcgaaagcgtggggagcgaacagg

SEQ ID NO: 1900 - DNA, 253 bp, Aquicella sp.
  Gammaproteobacteria; Coxiellaceae; Aquicella
tacagagggtgcaagcgttaatcggattgactgggcgtaaagggcgcgtaggcggtatgatgagtgtgatgtgaaagccccgggcttaacctgggaagtgcatcgcaaactatcaaactagagtatatgagagggtggcggaatttccggtgtagcggtgaaatgcgtagagatcggaaggaacgtcaatggcgaaggcagccacctggcataatactgacgctgaggcgcgaaagcgtggggagcaaacagg

SEQ ID NO: 1901 - DNA, 253 bp, Aquicella sp.
  Gammaproteobacteria; Coxiellaceae; Aquicella
tacagagggtgcaagcgttaatcggagttactgggcgtaaagggcgcgtaggcggtgaattgggtgtggtgtgaaagccccgggcttaacctgggaagtgcatcgcaaactaattgactggagtagatgagagggtggcggaatttccggtgtagcggtgaaatgcgtagagatcggaaggaacgtcaatggcgaaggcagccacctggcatcatactgacgctgaggcgcgagagcgtggggagcgaacagg

SEQ ID NO: 1902 - DNA, 253 bp, Aquicella sp.
  Gammaproteobacteria; Coxiellaceae; Aquicella
tacagagggtgcaagcgttaatcggaattactgggcgtaaagggcgcgtaggcggtgaaatgagtgggatgtgaaagccccgggcttaacctgggaagtgcatgccaaacgatttgactggagtataagagagggtggcggaatttccggtgtagcggtgaaatgcgtagagatcggaaggaacgtcaatggcgaaggcagccacctggcttaatactgacgctgaggcgcgaaagcgtggggatcaaacagg

SEQ ID NO: 1903 - DNA, 253 bp, Aquicella sp.
  Gammaproteobacteria; Coxiellaceae; Aquicella
tacagagggtgcgagcgttaatcggagttactgggcgtaaagggcgcgtaggcggatatatgagtgttatgtgaaagccctgggcttaacctgggaagtgcatagcaaacgatatatctggagtacaagagagggtggcggaatttccggtgtagcggtgaaatgcgtagagatcggaaggaacgtcgatggcgaaggcagccacctggcttgatactgacgctgaggcgcgaaagcgtggggagcgaacagg

SEQ ID NO: 1904 - DNA, 253 bp, Aquicella sp.
  Gammaproteobacteria; Coxiellaceae; Aquicella
tacagagggtgcgggcgttaatcggatttactgggcgtaaagggcgcgtaggcggttttatgagtgtggtgtgaaagccccgggcttaacctgggaagtgcaccgcaaacgataagactggagtagatgagagggtggcggaatttccggtgtagcggtgaaatgcgtagagatcggaaggaacgtcgatggcgaaggcagccacctggcatcatactgacgctgaggcgcgaaagcgtgggtagcgaacagg

SEQ ID NO: 1905 - DNA, 253 bp, Aquicella sp.
  Gammaproteobacteria; Coxiellaceae; Aquicella
tacagagggtgcgagcgttaatcggagttactgggcgtaaagggcgcgtaggcggtagtacatgtgtgatgtgaaagccccgggcttaacctgggaagtgcatcgcaaactgtgcaactagagtagatgagagggtggtggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1906 - DNA, 253 bp, Aquicella sp.
  Gammaproteobacteria; Coxiellaceae; Aquicella
tacagagggtgcgagcgttgatcggaattactgggcgtaaagggcgcgtaggcggttacatgagtgtgctgtgaaagccccgggcttaacctgggaagtgcagtgcaaacgatgtaactggagtagatgagagggtggtggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1907 - DNA, 253 bp, Aquicella sp.
  Gammaproteobacteria; Coxiellaceae; Aquicella
tacagagggtgcgagcgttaatcggatttactgggcgtaaagggcgcgtaggcggtcgtatgagtgtgatgtgaaagccccgggcttaacctgggaagtgcatcgcaaacgatacgactggagtaggtgagagggtggcggaatttccggtgtagcggtgaaatgcgtagagatcggaaggaacgtcaatggcgaaggcagccacctggttccatactgacgctgaggcgcgaaagcgtggggatcgaacagg

SEQ ID NO: 1908 - DNA, 253 bp, Aquicella sp.
  Gammaproteobacteria; Coxiellaceae; Aquicella
tacagagggtgcaagcgttaatcggatttactgggcgtaaagggcgcgtaggcggtttaccgagtgtgatgtgaaagccccgggcttaacctgggaagtgcatcgcaaacgggtagactagagtagatgagagggtgatggaatttccggtgtagcggtgaaatgcgtagagatcggaaggaacgtcgatggcgaaggcagtcacctggcatcatactgacgctgaggcgcgaaagcgtggggagcaaacagg

SEQ ID NO: 1909 - DNA, 253 bp, Aquicella sp.
  Gammaproteobacteria; Coxiellaceae; Aquicella
tacagagggtgcgagcgttaatcggagttactgggcgtaaagggtgcgtaggcggtttagtgggtgtgatgtgaaagccccgggcttaacctgggaagtgcatcgcaaactactgaactcgagtagatgagagggtggcggaatttccggtgtagcggtgaaatgcgtagagatcggaaggaacgtcaatggcgaaggcagccacctggcatcatactgacgctgaggcacgaaagcgtggggagcgaacagg

SEQ ID NO: 1910 - DNA, 253 bp, Aquicella sp.
  Gammaproteobacteria; Coxiellaceae; Aquicella
tacagagggtgcgagcgttaatcggagttactgggcgtaaagggcgcgtaggcggtgagatgagtgtgatgtgaaagccctgggcttaacctgggaagggcattgcaaacgatctgactggagtataagagagggtggcggaatttccggtgtagcggtgaaatgcgtagagatcggaaggaacgtcaatggcgaaggcagccacctggcttaatactgacgctgaggcgcgaaagcgtggggagcgaacagg

SEQ ID NO: 1911 - DNA, 253 bp, Aquicella sp.
  Gammaproteobacteria; Coxiellaceae; Aquicella
tacagagggtgcgagcgttaatcggagttactgggcgtaaagggtgcgtaggcggttaagtgagtgtgatgtgaaagccccgggcttaacctgggaagtgcatcgcaaacgacttaactggagtagatgagagggtgatggaatttccggtgtagcggtgaaatgcgtagagaccggaaggaacgtcgatggcgaaggcagtcacctggcatcatactgacgctgaggcacgaaagcgtggggagcgaacagg

SEQ ID NO: 1912 - DNA, 252 bp, Aquicella sp.
  Gammaproteobacteria; Coxiellaceae; Aquicella
tacagagggtgcgagcgttaatcggagttactgggcgtaaagggcgcgtaggcggagtaatgagtgttatgtgaaagccctggcttaacctgggaagtgcatagcaaacgattactctggagtacaagagagggtggcggaatttccggtgtagcggtgaaatgcgtagagatcggaaggaacgccaatggcgaaggcggccacctggcttgatactgacgctgaggcgcgaaagcgtggggagcgaacagg

SEQ ID NO: 1913 - DNA, 253 bp, Aquicella sp.
  Gammaproteobacteria; Coxiellaceae; Aquicella
tacagggggtgcgagcgttaatcggaattactgggtgtaaagggcgcgtaggcggcatgacatgtgtggtgtgaaagccccgggcttaacctgggaagtgcaccgcaaactgtcaggctagagtacatgagagggtggcggaatttccggtgtagcggtgaaatgcgtagagatcggaaggaacgtcaatggcgaaggcagccacctggcatgatactgacgctgaggcgcgaaagcgtggggagcgaacagg

SEQ ID NO: 1914 - DNA, 253 bp, Aquicella sp.
  Gammaproteobacteria; Coxiellaceae; Aquicella
tacagagggtgcaagcgttaatcggagttactgggcgtaaagggcgcgtaggcggtgatataggtgtgatgtgaaagccctgggcttaacctaggaagcgcatcgcaaacgatatgactagagtacaagagagggtggcggaatttccggtgtagcggtgaaatgcgtagagatcggaaggaacgtcgatggcgaaggcagccacctggcttgatactgacgctgaggcgcgagagcgtggggagcgaacagg

SEQ ID NO: 1915 - DNA, 253 bp, Aquicella sp.
  Gammaproteobacteria; Coxiellaceae; Aquicella
tacagagggtgcaagcgttaatcggagttactgggcgtaaagggcgcgtaggcggtagtatgagtgtgatgtgaaagccccgggcttaacctgggaagtgcatcgcaaacgatattactggagtactagagagggtggcggaatttccggtgtagcggtgaaatgcgtagagatcggaaggaacgtcgatggcgaaggcagccacctggctagatactgacgctgaggcgcgaaagcgtgggtagcgaacagg

SEQ ID NO: 1916 - DNA, 253 bp, Aquicella sp.
  Gammaproteobacteria; Coxiellaceae; Aquicella
tacagagggtgcgagcgttaatcggaattactgggtgtaaagggcgcgtaggcggtatggtgtgtgtgatgtgaaagccccgggcttaacctgggaagtgcatcacaaactgttgtactagagtatatgagagggtggcggaatttccggtgtagcggtgaaatgcgtagagatcggaaggaacgtcaatggcgaaggcagccacctggcataatactgacgctgaggcgcgaaagcgtggggagcgaacagg

SEQ ID NO: 1917 - DNA, 253 bp, Aquicella sp.
  Gammaproteobacteria; Coxiellaceae; Aquicella
tacggagggtgcgagcgttaatcggagttactgggcgtaaagggcgcgtaggcggatatatgagtgtgatgtgaaagccctgggcttaacctgggaagtgcatcgcaaacgataaatctggaatacaagagggggtggcggaatttccggtgtagcggtgaaatgcgtagagatcggaaggaacgccgatggcgaaggcagccacctggcttgatattgacgctgaggcgcgaaagcgtggggagcgaacagg

SEQ ID NO: 1918 - DNA, 253 bp, Aquicella sp.
  Gammaproteobacteria; Coxiellaceae; Aquicella
tacggagggtgcgagcgttaatcggatttactgggcgtaaagggcgcgtaggcggtgagatgtgagtggtgtgaaagccccgggcttaacctgggaagcgcatcgcagactatctgactggagtagatgagagggtggcggaatttccggtgtagcggtgaaatgcgtagagatcggaaggaacgtcaatggcgaaggcagccacctggtaccatactgacgctgaggcgcgaaagcgtggggatcgaacagg

SEQ ID NO: 1919 - DNA, 253 bp, Aquicella sp.
  Gammaproteobacteria; Coxiellaceae; Aquicella
tacagagggtgcaagcgttaatcggagttactgggcgtaaagggcgcgtaggcggttatatgagtgtgatgtgaaagccccgggcttaacctgggaagtgcatcgcaaacgatatgactggagtacaagagagggtggcggaatttccggtgtagcggtgaaatgcgtagagatcggaaggaacgtcaatggcgaaggcagccacctggcttgatactgacgctgaagcgcgaaagcgtggggagcgaacagg

SEQ ID NO: 1920 - DNA, 253 bp, Aquicella sp.
  Gammaproteobacteria; Coxiellaceae; Aquicella
tacagagggtgcgagcgttaatcggaattactgggcgtaaagggcgcgtaggcggttatgagagtgtgatgtgaaagccctgggcttaacctaggaagagcatcgcaaacgtcatgactggagtattggagagggtagcggaatttccggtgtagcggtgaaatgcgtagagatcggaaggaacgtcaatggcgagggcagctacctggccaaatactgacgctgaggcgcgaaagcgtggggagcaaacagg

SEQ ID NO: 1921 - DNA, 253 bp, Aquicella sp.
  Gammaproteobacteria; Coxiellaceae; Aquicella
tacagagggtgcgagcgttaatcggagttactgggcgtaaagggcgcgtaggcggttttaagagtgtgatgtgaaagccccgggcttaacctgggaagcgcatcgcaaacgataagactggagtgcaggagagggtggcggaatttccggtgtagcggtgaaatgcgtagagatcggaaggaacgtcaatggcgaaggcagccacctggcctgacactgacgctgaggcgcgaaagcgtggggagcgaacagg

SEQ ID NO: 1922 - DNA, 253 bp, Aquicella sp.
  Gammaproteobacteria; Coxiellaceae; Aquicella
tacagagggtgcgagcgttaatcggatttactgggcgtaaagggcgcgtaggcggtgagatgagtgtgatgtgaaagccccgggcttaacctgggaagtgcatcgcaaacgatctgactggagtatatgagagggtggcggaatttccggtgtagcggtgaaatgcgtagagatcggaaggaacgtcaatggcgaaggcagccacctggcataatactgacgctgaagcgcgaaagcgtggggatcgaacagg

SEQ ID NO: 1923 - DNA, 253 bp, Aquicella sp.
  Gammaproteobacteria; Coxiellaceae; Aquicella
tacagagggtgcaagcgttaatcggaattactgggcgtaaagggcgcgtaggcggtgagatgtgtgtgacgtgaaagccctgggcttaacctaggaagtgcatcgcaaactattttgctggagtatatgagagggtggcggaatttccggtgtagcggtgaaatgcgtagagatcggaaggaacgtcgatggcgaaggcagccacctggcataatactgacgctgaggcgcgaaagcgtggggagcgaacagg

SEQ ID NO: 1924 - DNA, 253 bp, Aquicella sp.
  Gammaproteobacteria; Coxiellaceae; Aquicella
tacagagggtgcgagcgttaatcggagttactgggtgtaaagggcgcgtaggcggcatgatgtgtgtgatgtgaaagccccgggcttaacctgggaagtgcattgcaaactattgagctagagtatgtgagagggtggcggaatttccggtgtagcggtgaaatgcgtagagatcggaaggaacgtcaatggcgaaggcagccacctggcacaatactgacgctgaggcgcgaaagcgtggggagcgaacagg

SEQ ID NO: 1925 - DNA, 253 bp, Aquicella sp.
  Gammaproteobacteria; Coxiellaceae; Aquicella
tacagagggtgcgagcgttaatcggagttactgggcgtaaagggcgcgtaggcggtgattcaagtgtgatgtgaaagccctgggcttaacctaggaagtgcatcgtagactgaatgactggagtatatgagagggtggcggaatttccggtgtagcggtgaaatgcgtagagatcggaaggaacgtcaatggcgaaggcagccacctggcataatactgacgctgaggcgcgaaagcgtggggagcgaacagg

SEQ ID NO: 1926 - DNA, 253 bp, Aquicella sp.
  Gammaproteobacteria; Coxiellaceae; Aquicella
tacagagggtgcgagcgttaatcggaattactgggcgtaaagggtgcgtaggcggtttaatgagtgtgatgtgaaagccccgggcttaacctgggaagagcattgcaaacgattagactggagtattggagagggtggcggaatttccggtgtagcggtgaaatgcgtagagatcggaaggaacgtcgatggcgaaggcagccacctggccaaatactgacgctgaggcacgaaagcgtggggagcgaacagg

SEQ ID NO: 1927 - DNA, 253 bp, Aquicella sp.
  Gammaproteobacteria; Coxiellaceae; Aquicella
tacagagggtgcaagcgttaatcggagttactgggcgtaaagggcgcgtaggcggttgcgtgagtgtgatgtgaaagccctgggcttaacctaggaagtgcatcgcaaacgacgtaactggagtataagagagggtggcggaatttccggtgtagcggtgaaatgcgtagagatcggaaggaacgtcaatggcgaaggcagccacctggcttaatactgacgctgaggcgcgaaagcgtggggagcaaacagg

SEQ ID NO: 1928 - DNA, 253 bp, Aquicella sp.
  Gammaproteobacteria; Coxiellaceae; Aquicella
tacagagggtgcgagcgttgatcggagttactgggcgtaaagggcgcgtaggcggttatatgagtgtgctgtgaaagccccgggcttaacctgggaagtgcagtgcaaacgatataactggagtagatgagagggtggtgggatttccggtgtagcggtgaaatgcgtagagatcggaaggaacgtcagtggcggaggcagccacctggcatcatactgacgctgaggcgcgaaagcatggggagcaaacagg

SEQ ID NO: 1929 - DNA, 253 bp, Aquicella sp.
  Gammaproteobacteria; Coxiellaceae; Aquicella
tacagagggtgcgagcgttaatcggagttactgggcgtaaagggcgcgtaggcggatataagagtgtgatgtgaaagccccgggcttaacccgggaagtgcatcgcaaacgttgtacctggagtagatgagagggtggcggaatttccggtgtagcggtgaaatgcgtagagatcggcaggaacgtcgatggcgaaggcagccacctggcatcatactgacgctgaggcgcgaaagcgtgggtagcgaacagg

SEQ ID NO: 1930 - DNA, 253 bp, Aquicella sp.
  Gammaproteobacteria; Coxiellaceae; Aquicella
tacagagggtgcaagcgttaatcggagttactgggcgtaaagggcgcgtaggcggtatattgggtgtggtgtgaaagccttgggcttaacctgagaagtgcatcgcaaactaataaactggagtatatgagagggtggcggaatttccggtgtagcggtgaaatgcgtagagatcggaaggaacgtcaatggcgaaggcagccacctggcataatactgacgctgaggcgcgagagcgtggggagcgaacagg

SEQ ID NO: 1931 - DNA, 253 bp, Aquicella sp.
  Gammaproteobacteria; Coxiellaceae; Aquicella
tacagagggtgcgagcgttaatcggatttactgggcgtaaagggcgcgtaggcggcgagatgtgtgtgatgtgaaagccccgagctcaacctgggaagtgcatcgcaaactgtctgactggagtatatgagagggtggcggtatttccggtgtagcggtgaaatgcgtaaagatcggaaggaacgtcgatggcgaaggcagccacctggcataatactgacgctgaggcgcgaaagcgtggggatcgaacagg

SEQ ID NO: 1932 - DNA, 253 bp, Aquicella sp.
  Gammaproteobacteria; Coxiellaceae; Aquicella
tacgaagggtgcgagcgttaatcggaatgactgggtgtaaagggcgcgtaggcggtaagatgagtgtgatgtgaaagccccgggcttaacctgggaagtgcatcgcaaactatttaactagagtatatgagagggtggcggaatttccggtgtagcggtgaaatgcgtagagatcggaaggaacgtcagtggcgaaggcagccacctggcataatactgacgctgaggcgcgaaagcgtggggagcgaacagg

SEQ ID NO: 1933 - DNA, 253 bp, Aquicella sp.
  Gammaproteobacteria; Coxiellaceae; Aquicella
tacagagggtgcgagcgttaatcggagttactgggtgtaaagggcgcgtaggcggtgttatgtgtgtgatgtgaaagccccgggcttaacctgggaagtgcatcgcaaactatagtactagagtatatgagagggtggcggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1934 - DNA, 253 bp, Aquicella sp.
  Gammaproteobacteria; Coxiellaceae; Aquicella
tacagagggtgcgagcgttaatcggagttactgggcgtaaagggcgcgtaggcggttatataagtgtgatgtgaaagccccgggcttaacctgggaagggcatcgcggactgtgtaactggagtatatgagagggtgtcggaatttccggtgtagcggtgaaatgcgtagagatcggaaggaacgtcgatggcgaaggcaggcacctggcataatactgacgctgaggcgcgaaagcgtgggtagcgaacagg

SEQ ID NO: 1935 - DNA, 253 bp, Rickettsiella sp.
  Gammaproteobacteria; Coxiellaceae; Rickettsiella
tacagagggtgcaagcgttaaccaggataactgggcgtaaagggcgtgtaggtggttgactaggtttgatgtgaaatccccgggcttaacctgggaattgcgtcgaaaacgggtcgactagagtgagatagagggttgtggaatttccggtgtagcggtgaaatgcgtagatatcgggaagaacatcagtggcgaaggcgacaacctggatcttaactgacactgaggcgcgaaggcgtggggagcaaacagg

SEQ ID NO: 1936 - DNA, 253 bp, Rickettsiella sp.
  Gammaproteobacteria; Coxiellaceae; Rickettsiella
tacagagggtgcaagcgttaatcagaatgactgggcgtaaagggcgtgtaggtggttgactaggtttgatgtgaaatccccgggcttaacctgggaatggcgtcgaaaacgggttgactagagtgagagagagggttgtggaatttccggtgtagcggtgaaatgcgtagatatcggaaagaacatcagtggcgaaggcgacaacctggctcttaactgacactgaggcgcgaaggcgtggggagcaaacagg

SEQ ID NO: 1937 - DNA, 253 bp, Rickettsiella sp.
  Gammaproteobacteria; Coxiellaceae; Rickettsiella
tacagagggtgcaagcgttaatcagaatgactgggcgtaaggggcgtgtaggtggttgactaggtttgatgtgaaatccccgggcttaacctgggaattgcgtcgaaaacgggtcgactggagtgagatagagggttgtggaatttccggtgtagcggtgaaatgcgaagatatcggaaagaacatcagtggcgaaggcgacaacctggatcttaactgacactgaggcgcgaaagcgtggggagcaaacagg

SEQ ID NO: 1938 - DNA, 252 bp, Unknown
  Description of Unknown: bacterium polynucleotide
  Gammaproteobacteria; Enterobacteriaceae
tacggagggtgcaagcgttaatcggaattactgggcgtaaaacgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggagtaccggtggcgaaggcggccccctggacaaagactgacgccaggtgcgaaagcgtggggagcaaacagg

SEQ ID NO: 1939 - DNA, 253 bp, Unknown
  Description of Unknown: bacterium polynucleotide
  Gammaproteobacteria; Enterobacteriaceae
tacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggggaaaggaggagagatctggaggaagaccgggggcgaaggcggccccctggacaaagactgacgctcaggtgcgaaagcgtggggagcaaacagg

SEQ ID NO: 1940 - DNA, 253 bp, Unknown
  Description of Unknown: bacterium polynucleotide
  Gammaproteobacteria; Enterobacteriaceae
tacggagggtgcaagcgttaatcgggattactgggcgtaaagcgcacgcaggcggtctgtcaagtcggatgtgaaatccccgggcttaacctgggaactgcattcgaaaccggcaggctagagtcttgtaggggggggtagaattccaggtgtagcggtgaaatgcgtagagatctggaggaataccggtggcgaaggcggccccctggacaaagactgacgctcaggagcgaaagcgtggggagcaaacagg

SEQ ID NO: 1941 - DNA, 253 bp, Unknown
  Description of Unknown: bacterium polynucleotide
  Gammaproteobacteria; Enterobacteriaceae
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgaggagagatagggaggtagaaagggggagaaggaggaaaaagggaaaaagaaggaagagaaggggagaaagcgggggaagaagaaagg

SEQ ID NO: 1942 - DNA, 253 bp, Unknown
  Description of Unknown: bacterium polynucleotide
  Gammaproteobacteria; Enterobacteriaceae
tacggagggtgcaagcgttaatcggaattactgggcgtaaagcgcacgcaggcggtctgttaagtcaggtgtgaaatccccgggcttaacctgggaactgcatttgaaactggcaggcttgagtcttgtagaggggggtagaattccaggtgtagcggtgaaatgcgtagagatctggaggaagaaaggtggcgaaggaggaacccgggaaaaggactgacgctcaggtgcgaaagcgtggggagcaaacagg

SEQ ID NO: 1943 - DNA, 253 bp, Unknown
  Description of Unknown: bacterium polynucleotide
  Gammaproteobacteria; Enterobacteriaceae
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagaggggaaaggagtagagagcgggaggcaaaaagtgggagctggcggccccctggacaaagactgacgcgcaggtgcgaaagcgtggggagcaaacagg

SEQ ID NO: 1944 - DNA, 253 bp, Unknown
  Description of Unknown: bacterium polynucleotide
  Gammaproteobacteria; Enterobacteriaceae
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcggagagatcgggaggaagaaagggggagaaggcggcccccgggaaaaagacggacgcgaaagggagaaagcgtggggagcaaacagg

SEQ ID NO: 1945 - DNA, 253 bp, Unknown
  Description of Unknown: bacterium polynucleotide
  Gammaproteobacteria; Enterobacteriaceae
tccttcttttgaccgcgttcctcttcattcctgggcgtaaatctccctccttctttctgttaattccgctgtgaaatccccggtcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1946 - DNA, 253 bp, Unknown
  Description of Unknown: bacterium polynucleotide
  Gammaproteobacteria; Enterobacteriaceae
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtatagcggtgaaatgcgtagagatctggaggaagaaagttggagaaggaaaaaaaagggaaaaagactgacgctcaggtgcgaaagcgtggggagcaaacagg

SEQ ID NO: 1947 - DNA, 253 bp, Unknown
  Description of Unknown: bacterium polynucleotide
  Gammaproteobacteria; Enterobacteriaceae
tccggagggttccagcgttcctcggccttcctttttttccctctccctcctgctttctgttaagtcagctgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1948 - DNA, 253 bp, Unknown
  Description of Unknown: bacterium polynucleotide
  Gammaproteobacteria; Enterobacteriaceae
tacggagggttcaagcgttcctcttccttccttttcttccctctccctcctgctgtctgttaagtcatatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1949 - DNA, 253 bp, Unknown
  Description of Unknown: bacterium polynucleotide
  Gammaproteobacteria; Enterobacteriaceae
tccgtctttagccctcttgaatcttaattccttggcgttactctccctccgtctttcttttccttcctctgtgccctccccgttcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1950 - DNA, 253 bp, Buchnera sp.
  Gammaproteobacteria; Enterobacteriaceae; Buchnera
tacggagggtgctagcgttaatcagaattactgggcgtaaagagcgcgtaggtggttttttaagtcagatgtgaaatccctaggcttaacctaggaactgcatttgaaactaaaagactagagtttcgtagagggaggtagaattctaggtgtagcggtgaaatgcgtagatatctggaggaatacctgtggcgaaagcggcctcctagacgggaactgacactgaggcgcgaaagcgtggggagcaaacagg

SEQ ID NO: 1951 - DNA, 253 bp, Buchnera sp.
  Gammaproteobacteria; Enterobacteriaceae; Buchnera
tacggagggtgcaagcgttaatcagaattactgggcgtaaagagctcgtaggtggttttttaagtcagatgtgaaatccctaggcttaacctaggaactgcatttgaaactgaaaagctagagtatcgtagagggaggtagaattctaggtgtagcggtgaaatgcgtagatatctggaggaatacctgtggcgaaagcggcctcctaaacgaatactgacactgaggtgcgaaagcgtggggagcaaacagg

SEQ ID NO: 1952 - DNA, 253 bp, Enterobacter sp.
  Gammaproteobacteria; Enterobacteriaceae; Enterobacter
tacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagctctggaggattaccgtggacgacggcggccccctggacaaagactgacgctcatttgcgaaagcgtggggagcaaacagg

SEQ ID NO: 1953 - DNA, 254 bp, Erwinia sp.
  Gammaproteobacteria; Enterobacteriaceae; Erwinia
gacgggggggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1954 - DNA, 253 bp, Erwinia sp.
  Gammaproteobacteria; Enterobacteriaceae; Erwinia
tacggagggtgcgagcgttaatcggaatgactgggcgtaaagggcacgcaggcggtgagtcaagtcagatgtgaaatccccgggctcaacccgggaacggcatttgaaactggcgcactggagtctcgcagaggggggcagaattccgggtgtagcggtgaaatgcgtagatatccggaggaataccggtggcgaaggcggccccctggacgaagactgacgctgaggtgcgaaagcgtgggtagcaaacagg

SEQ ID NO: 1955 - DNA, 252 bp, Pantoea agglomerans
  Gammaproteobacteria; Enterobacteriaceae; Pantoea agglomerans
gacggggtgtaaagtgttcttcagaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1956 - DNA, 253 bp, Pantoea sp.
  Gammaproteobacteria; Enterobacteriaceae; Pantoea
tacggagggtgcaagcgttaatcggaattacagggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggaggcaccctggacaaagaaggaagctcaggggcgaaagcgtggggagaaaacagg

SEQ ID NO: 1957 - DNA, 253 bp, Pantoea sp.
  Gammaproteobacteria; Enterobacteriaceae; Pantoea
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagagagggaggaataaaggtggagaaggcggcccccgggaaaaagactgacgagaaggggagaaagcgtggggagcaaacagg

SEQ ID NO: 1958 - DNA, 253 bp, Pantoea agglomerans
  Gammaproteobacteria; Enterobacteriaceae; Pantoea agglomerans
tacggagggttcaagcgttaatcggacttccttttcttcccgcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1959 - DNA, 253 bp, Candidatus portiera
  Gammaproteobacteria; Halomonadaceae; Candidatus Portiera
tacggaaggtgcaagcgttaatcggaattactgggcgtaaagcgcgcgtaggtggtttgttaagttggatgtgaaagccctgggctcaacctaggaactgcatccaaaactaactcactagagtacgatagagggaggtagaattcatagtgtagcggtggaatgcgtagatattatgaagaataccagtggcgaaggcggcctcctggatctgtactgacactgaggtgcgaaagcgtgggtagcgaacagg

SEQ ID NO: 1960 - DNA, 253 bp, Haererehalobacter salaria
  Gammaproteobacteria; Halomonadaceae; Haererehalobacter salaria
tacggagggtgcgagcgttaatcggaattactgggcgtaaagcgcgcgtaggtggcttggcacgccggttgtgaaagccccgggctcaacctgggaacggcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacagg

SEQ ID NO: 1961 - DNA, 253 bp, Halomonas sp.
  Gammaproteobacteria; Halomonadaceae; Halomonas
tacggagggtgcgagcgttaatcggaattactgggcgtaaagcgcgcgtaggcggcgtgataagccggttgtgaaagccccgggctcaacctgggaacggcatccggaactgtcaggctagagtgcaggagaggaaggtagaattcccggtgtagcggtgaaatgcgtagagatcgggaggaataccagtggcgaaggcggccttctggactgacactgacgctgaggtgcgaaagcgtgggtagcaaacagg

SEQ ID NO: 1962 - DNA, 253 bp, Unknown
  Description of Unknown: bacterium polynucleotide
  Gammaproteobacteria; HTCC2188; HTCC
tacggagggtgcaagcgttaatcggaattactgggcgtaaagcgcgcgtaggcggtttggtaagttggatgtgaaagcccagggctcaaccttggaactgcattcaaaactgccaggctagagtacggtagaggggggtagaattccacgtgtagcggtgaaatgcgtagagatgtggaggaataccagtggcgaaggcggccccctggatcgatactgacgctgaggtgcgaaagcgtggggagcaaacagg

SEQ ID NO: 1963 - DNA, 253 bp, Unknown
  Description of Unknown: bacterium polynucleotide
  Gammaproteobacteria; Legionellaceae
tacggagggtgcaagcgttaatcggaattactgggcgtaaagggtgcgtaggtggttacttaagttagctgtgaaatacctgggctcaagctggggaagtcagctaagactgaataacttgagtataggagagggtagtggaatttccggtgtagcggtgaaatgcgtagagatcggaaggaacaccagtggcgaaggcggctacctggcctgatactgacactgaggcacgaaagcgtggggagcaaacagg

SEQ ID NO: 1964 - DNA, 253 bp, Unknown
  Description of Unknown: bacterium polynucleotide
  Gammaproteobacteria; Legionellaceae
tacggagggtgcgagcgttaatcggaattattgggcgtaaagggtgcgtaggcggtgatataagttagctgtgaaatacctgagcttaacttgggggtgtcagctaagactgtatgactggagtataggagagggtagtggaatttccggtgtagcggtgaaatgcgtagagatcggaaggaacaccggtggcgaaggcggctacctggcctaatactgacgctgaggcacgaaagcgtggggagcaaacagg

SEQ ID NO: 1965 - DNA, 253 bp, Unknown
  Description of Unknown: bacterium polynucleotide
  Gammaproteobacteria; Legionellaceae
tacggagggtgcaagcgttaatcggaattattgggcgtaaagggtgcgtaggtggttgaataagttatctgtgaaatccccgggcttaacctgggcaggtcagataagactgtttaactcgagtatgggagagggtagtggaatttccggtgtagcggtgaaatgcgtagagatcggaaggaacaccagtggcgaaggcggctacctggccggatactgacactgaagcacgaaagcgtggggagcaaacagg

SEQ ID NO: 1966 - DNA, 253 bp, Unknown
  Description of Unknown: bacterium polynucleotide
  Gammaproteobacteria; Legionellaceae
tacggagggtgcgagcgttaatcggaattactgggcgtaaagggtgcgtaggtggtttattaagttatctgtaaaatccccgggcttaacctgggaaggccagataagactgatagactcgagtatgggagagggtagtggaatttccggtgtagcggtgaaatgcgtagatatcggaaggaacaccagtggcgaaggcggctacctggcctaatactgacactgaggcacgaaagcgtggggagcaaacagg

SEQ ID NO: 1967 - DNA, 253 bp, Unknown
  Description of Unknown: bacterium polynucleotide
  Gammaproteobacteria; Legionellaceae
tacggagggtgcgagcgttaatcggaatgactgggcgtaaagggtgtgtaggcggtttgataagttaggtgtgaaatacccgggcttaacctgggaaggtcacttaagactgtcagactagagtataggagagggtagtggaatttccggtgtagcggtgaaatgcgtagagatcggaaggaacaccagtggcgaaggcggctacctggcctaatactgacgctgagacacgaaagcatggggagcaaacagg

SEQ ID NO: 1968 - DNA, 253 bp, Unknown
  Description of Unknown: bacterium polynucleotide
  Gammaproteobacteria; Legionellaceae
tacagagggtgcgagcgttaatcggaattactgggcgtaaagggcgcgtaggtggttatgtaagatggatgtgaaattcctgggcttaacctaggcacggcatcggtgactgcatagcttgagtactgtagagggtagtggaatttccggtgtagcggtgaaatgcgtagagatcggaaggaacaccggtggcgaaggcggctacctggacagagaccgacactgaggcgcgaaagcgtgggtagcaaacagg

SEQ ID NO: 1969 - DNA, 253 bp, Unknown
  Description of Unknown: bacterium polynucleotide
  Gammaproteobacteria; Legionellaceae
tacggagggtgcaagcgttaatcggaattactgggcgtagagggtgcgtaggcggtttaataagttaagtgtgaaagtcctgggcttaacctaggggagtcatttaggactgttagactagagtatgggagagggtagtggaattcccggtgtagcggtgaaatgcgtagagatcggaaggaacaccagtggcgaaggcggctacctggcctaatactgacgctgaggcacgaaagcatggggagcaaacagg

SEQ ID NO: 1970 - DNA, 253 bp, Unknown
  Description of Unknown: bacterium polynucleotide
  Gammaproteobacteria; Legionellaceae
tacggagggtgcaagcgttaatcggaattactgggcgtaaagggtgcgtaggtggttgtataagttatctgtgaaatccctgggcttaacctaggaaggtcagataagactgtatgactcgagtatgggagagggtagtggaatttccggtgtagcggtgaaatgcgtagagatcggaaggaacaccagtggcgaaggcggctacctggcccaatactgacactgaggcacgaaagcgtggggagcaaacagg

SEQ ID NO: 1971 - DNA, 253 bp, Legionella sp.
  Gammaproteobacteria; Legionellaceae; Legionella
tacggagggtgcgagcgttaatcggaattactgggcgtaaagggtgcgtaggtggttgactaagttatctgtgaaattcctgggcttaacctgggcaggtcagatgatactggacgactcgagtatgggagagggtagtggaatttccggtgtagcggtgaaatgcgtagagatcggaaggaacaccagtggcgaaggcggctacctggcctaatactgacactgaggcacgaaagcgtggggagcaaacagg

SEQ ID NO: 1972 - DNA, 253 bp, Legionella sp.
  Gammaproteobacteria; Legionellaceae; Legionella
tacggagggtgcgagcgttaatcggaattattgggcgtaaagggtgcgtaggtggtttgttaagttatctgtgaaaaccctgggcttaacctggggctgggagataagactggcagactggagtatgggagagggtagtggaatttccggtgtagcggtgaaacgcgtagagatcggaaggaacaccagtggcgaaggcggctacctggacaaatactgacgctgaggcgcgaaagcgtggggagcaaacagg

SEQ ID NO: 1973 - DNA, 253 bp, Legionella sp.
  Gammaproteobacteria; Legionellaceae; Legionella
tacggagggtgcgagcgttaatcggaattactgggcgtaaagggtgcgtaggtggttgattaagttatctgtgaaatacctgggcttaacctgggcaggtcagatgatactgattgactcgagtacgggagagggtagtggaatttccggtgtagcggtgaaatgcgtagagatcggaaggaacaccggtggcgaaggcggctacctggcctgatactgacactgaggcacgaaagcgtggggagcaaacagg

SEQ ID NO: 1974 - DNA, 253 bp, Legionella sp.
  Gammaproteobacteria; Legionellaceae; Legionella
tacagagggtgcgagcgttaatcggaattactgggcgtaaagggtgcgtaggtggatatttaagttagctgtgaaattcctgggcttaacctagggtggtcagctaagactggatatctcgagtataggagagggtagtggaatttccggtgtagcggtgaaatgcgtagagatcggaagggacaccagtggcgaaggcggctacctggaccaatactgacgctgaggcgcgaaagcgtggggatcaaacagg

SEQ ID NO: 1975 - DNA, 253 bp, Legionella sp.
  Gammaproteobacteria; Legionellaceae; Legionella
tacggagggtgcgagcattaatcggaataattgggcgtaaagagtgcgtaggtggtttgctaagtgagttgtgaaagacctgggcttaacctgggggtgtcaactcaaacgggcagactagagtacagtagagggtcgtggaatttccggtgtagcggtgaaatgcgtagagatcggaaggaacgtcaatggcgaaggcagccacctggcttgatactgacgctgaagcgcgaaagcgtggggagcgaacagg

SEQ ID NO: 1976 - DNA, 253 bp, Legionella sp.
  Gammaproteobacteria; Legionellaceae; Legionella
tacggagggtgcaagcgttaatcggaattactgggcgtaaagagtgcgtaggtggttaattaagttatctgtgaaatccctgggctcaacctgggcaggtcagatgatactgattgactcgagtacgggagagggtagtggaatttccggtgtagcggtgaaatgcgtagagatcggaaggaacaccagtggcgaaggcggctacctggcctgatactgacactggggcgcgaaagcgtggggagcgaacagg

SEQ ID NO: 1977 - DNA, 253 bp, Legionella sp.
  Gammaproteobacteria; Legionellaceae; Legionella
tacggagggtgcaagcgttatccggattcactgggtttaaagggtgcgtaggttgcaatgtaagttataggtaaaatcactgggctcaacctggttaggaattataatactgcatagctagaggatgggagagggtagtggaatttccggtgtagcggtgaaatgcgtagagatcggaaggaacaccagttgcgaaggcggctacctgggctgatactgacgctgaggcgcgagagcgtggggagcaaacagg

SEQ ID NO: 1978 - DNA, 253 bp, Acinetobacter rhizosphaerae
  Gammaproteobacteria; Moraxellaceae; Acinetobacter rhizosphaerae
tacagagggtgcaagcgttaatcggatttactgggcgtaaagcgcgcgtaggcggccaattaagtcaaatgtgaaatccccgagcttaacttgggaattgcattcgatactggttggctagagtgtgggagaggatggtagaattccaggtgtagcggtgaaatgcgtagagatctggaggaataccgatggcgaaggcagccatctggcctaacactgacgctgaggtgcgaaagcatggggagcaaacagg

SEQ ID NO: 1979 - DNA, 253 bp, Acinetobacter sp.
  Gammaproteobacteria; Moraxellaceae; Acinetobacter
tacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 1980 - DNA, 253 bp, Acinetobacter sp.
  Gammaproteobacteria; Moraxellaceae; Acinetobacter
tacagagggtgcgagcgttaatcggatttactgggcgtaaagcgcgcgtaggtggttaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacactgaggtgcgaaagcatggggagcaaacagg

SEQ ID NO: 1981 - DNA, 253 bp, Acinetobacter sp.
  Gammaproteobacteria; Moraxellaceae; Acinetobacter
tacagagggtgcgagcgttaatcggatttactgggcgtaaagcgtgcgtaggtggccaattaagtcaaatgtgaaatccctgagcttaacttaggaattgcattcgatactggttggctagagtatgggagaggatggtagaattccaggtgtagcggtgaaatgcgtagagatctggaggaataccgatggcgaaggcagccatctggcctaatactgacactgaggcacgaaagcatggggagcaaacagg

SEQ ID NO: 1982 - DNA, 253 bp, Agitococcus lubricus
  Gammaproteobacteria; Moraxellaceae; Agitococcus lubricus
tacagaggatgcaagcgttatccggaatgattgggcgtaaagcgtgcgtaggcggtatgttaagtcggatgtgaaatccctgggctcaacctaggcattgcgtccgatactggcacactagagtgtgggagaggaaggtagaattccaggtgtagcggtgaaatgcgtagagatctggaggaataccgatggcgaaggcagccttctggcctaacactgacgctgaggtgcgaaagcatggggagcaaacagg

SEQ ID NO: 1983 - DNA, 253 bp, Alkanindiges sp.
  Gammaproteobacteria; Moraxellaceae; Alkanindiges
tacagagggtgcgagcgttaatcggaattactgggcgtaaagcgcgcgtaggcggcttgttaagtcggatgtgaaatccctgggctcaacctaggcattgcattcgatactggcaagctagagtatgggagaggaaggtagaattccaggtgtagcggtgaaatgcgtagagatctggtggaataccgatggcgaaggcagccttctggcctaatactgacgctgaggtgcgaaagcatggggagcaaacagg

SEQ ID NO: 1984 - DNA, 253 bp, Alkanindiges sp.
  Gammaproteobacteria; Moraxellaceae; Alkanindiges
tacgtagggtgcgagcgttaatcggaattactgggcgtaaagcgcgcgtaggcggcttgttaagtcgaatgtgaaatcccccagcttaacttgggcattgcattcgatactggcaagctagagtatgggagaggaaggtagaattccaggtgtagcggtgaaatgcgtagagatctggaggaataccgatggcgaaggcagccttctggactaatactgacgctgaggtgcgaaagcatggggagcaaacagg

SEQ ID NO: 1985 - DNA, 253 bp, Enhydrobacter sp.
  Gammaproteobacteria; Moraxellaceae; Enhydrobacter
tacagagggtgcgagcgttaatcggaattactgggcgtaaagcgagcgtaggtggttgattaagtcagctgtgaaatccccgggcttaacctgggaaagtcagctgatactggttaactagagtatgtgagaggaaagtagaattccaggtgtagcggtgaaatgcgtagagatctggaggaataccgatggcgaaggcagctttctggcataatactgacactgaggttcgaaagcgtgggtagcaaacagg

SEQ ID NO: 1986 - DNA, 254 bp, Enhydrobacter sp.
  Gammaproteobacteria; Moraxellaceae; Enhydrobacter
tacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacagg

SEQ ID NO: 1987 - DNA, 253 bp, Moraxella sp.
  Gammaproteobacteria; Moraxellaceae; Moraxella
tacagagggtgcaagcgttaatcggaattactgggcgtaaagcgcgcgtaggtggttatttaagtcagatgtgaaagccccgggcttaacctgggaactgcatctgatactggataactagagtaggtgagaggggagtagaattccaggtgtagcggtgaaatgcgtagagatctggaggaataccgatggcgaaggcagctccctggcatcatactgacactgaggtgcgaaagcgtgggtagcaaacagg

SEQ ID NO: 1988 - DNA, 253 bp, Psychrobacter sp.
  Gammaproteobacteria; Moraxellaceae; Psychrobacter
tacagagggtgcaagcgttaatcggaattactgggcgtaaagggagcgtaggtggctctataagtcagatgtgaaatccccgggcttaacctgggaactgcatctgaaactgtagagctagagtatgtgagaggaaggtagaattccaggtgtagcggtgaaatgcgtagagatctggaggaataccgatggcgaaggcagccttctggcataatactgacactgaggctcgaaagcgtgggtagcaaacagg

SEQ ID NO: 1989 - DNA, 253 bp, Psychrobacter sanguinis
  Gammaproteobacteria; Moraxellaceae; Psychrobacter sanguinis
tacagagggtgcaagcgttaatcggaattactgggcgtaaagcgagcgtaggtggcttgataagtcagatgtgaaatccccgggcttaacctgggaactgcatctgatactgttgggctagagtaggtgagagggaggtagaacttcaggtgtagcggtgaaatgcgtagagatctgaaggaataccgatggcgaaggcagcctcctggcatcatactgacactgaggttcgaaagcgtgggtagcaaacagg

SEQ ID NO: 1990 - DNA, 253 bp, Psychrobacter pulmonis
  Gammaproteobacteria; Moraxellaceae; Psychrobacter pulmonis
tacagagggtgcaagcgttaatcggaattactgggcgtaaagcgagcgtaggtggcttgataagtcagatgtgaaagccccgggcttaacctgggaacggcatctgatactgttaggctagagtaggtgagaggaaggtagaattccaggtgtagcggtgaaatgcgtagagatctggaggaataccgatggcgaaggcagccttctggcatcatactgacactgaggttcgaaagcgtgggtagcaaacagg

SEQ ID NO: 1991 - DNA, 253 bp, Marinomonas sp.
  Gammaproteobacteria; Oceanospirillaceae; Marinomonas
tacagagggtgcaagcgttaatcggaattactgggcgtaaagcgcgcgtaggtggtttgttaagtcggatgtgaaatcccagggctcaaccttggaatggcacccgatactggcaggctagagtatggtagaggggtgtggaatttcctgtgtagcggtgaaatgcgtagatataggaaggaacatcagtggcgaaggcgacaccctggactaatactgacactgaggtgcgaaagcgtggggagcaaacagg

SEQ ID NO: 1992 - DNA, 253 bp, Unknown
  Description of Unknown: bacterium polynucleotide
  Gammaproteobacteria; Pasteurellaceae
tacggagggtgcgagcgttaatcggaatgactgggcgtaaagggcacgcaggcggattgttaagtgagatgtgaaagccccgggcttaacctgggaattgcatttcagactggcaatctagagtattttagggaggggtagaattccacgtgtagcggtgaaatgcgtagagatgtggaggaataccgaaggcgaaggcagcctcctgggataacactgacgttcatgctcgaaagcatggggagcaaacagg

SEQ ID NO: 1993 - DNA, 253 bp, Actinobacillus parahaemolyticus
  Gammaproteobacteria; Pasteurellaceae; Actinobacillus parahaemolyticus
tacggggggtgcgagcgttaatcggaataactgggcgtaaagggcacgcaggcggtgacttaagtgagatgtgaaagccccgagcttaacttgggaattgcatttcatactgggtcgctagagtactttagggaggggtagaattccacgtgtagcggtgaaatgcgtagagatgtggagggataccgaaggcgaaggcagccccttgggaatgtactgacgctcatgtgcgaaagcgtggggagcaaacagg

SEQ ID NO: 1994 - DNA, 253 bp, Aggregatibacter sp.
  Gammaproteobacteria; Pasteurellaceae; Aggregatibacter
tacggagggtgcgagcgttaatcggaataactgggcgtaaagggcacgcaggcggacttttaagtgaggtgtgaaatccccgggcttaacctgggaattgcatttcagactgggagtctagagtactttagggaggggtagaattccacgtgtagcggtgaaatgcgtagagatgtggaggaataccgaaggcgaaggcagccccttgggaatgtactgacgctcatgtgcgaaagcgtggggagtaaacagg

SEQ ID NO: 1995 - DNA, 253 bp, Haemophilus parainfluenzae
  Gammaproteobacteria; Pasteurellaceae; Haemophilus parainfluenzae
tacggagggtgcgagcgttaatcggaataactgggcgtaaagggcacgcaggcggtgacttaagtgaggtgtgaaagccccgggcttaacctgggaattgcactccatactgggtcgctagagtactttagggaggggtagaattccacgtgtagcggtgaaatgcgtggagatgtggaggaataccgaaggcgaaggcagccccttgggaatgtactgacgctcatgtgcgaaagcgtggggagcaaacagg

SEQ ID NO: 1996 - DNA, 253 bp, Haemophilus sp.
  Gammaproteobacteria; Pasteurellaceae; Haemophilus
tacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 1997 - DNA, 253 bp, Unknown
  Description of Unknown: bacterium polynucleotide
  Gammaproteobacteria; Piscirickettsiaceae
tacggagggtgcaagcgttaatcggaattactgggcgtaaagcgcacgcaggtggctgagaaagtcgattgtgaaagccctgggcttaacctgggaattgcagtcgaaactacttagctagagtatgggagagggcagtggaattcccggtgtagcggtgaaatgcgtagatatcgggaggaacatcagtggcgaaggcggctgcctggcccaatactgacactcaggtgcgacagcgtggggagcaaacagg

SEQ ID NO: 1998 - DNA, 253 bp, Unknown
  Description of Unknown: bacterium polynucleotide
  Gammaproteobacteria; Piscirickettsiaceae
tacggagggtgcaagcgtcaatcggaattactgggcgtaaagcgcacgcaggtggctgagtcagtcgattgtgaaagccctgggcttagcctgggaattgcagtcgatactactcagctagagtatgggagagggtagtggaattcccggtgtagcggtgaaatgcgtagatatcgggaggaacatcagtggcgaaggcggctacctggcccaatactgacactcaggtgcgacagcgtggggagcaaacagg

SEQ ID NO: 1999 - DNA, 253 bp, Methylophaga sp.
  Gammaproteobacteria; Piscirickettsiaceae; Methylophaga
tacggagggtgcaagcgttaatcggaattactgggcgtaaagcgcgcgtaggcggtttgttatgtcagatgtgaaatccccgggctcaacctgggaatggcatttgagactggcaggctagagtgtggtagaggtgagtggaatttcaggtgtagcggtgaaatgcgtagagatctgaaggaacatcagtggcgaaggcgactcactgggccattactgacgctgaggtgcgaaagcgtgggtagcaaacagg

SEQ ID NO: 2000 - DNA, 253 bp, Unknown
  Description of Unknown: bacterium polynucleotide
  Gammaproteobacteria; Pseudomonadaceae
tacgaagggggctagcgttaatcggaattactgggcgtaaagcgcgcgtaggtggtttgccaagttgaatgcgaaatccccgggctcaacctgggaactgcatccaaaactggcaggctagagtatggtagagggtggtggaatttcctgtgtagcggtgaaatgcgtagatatgggaaggaacatcagtggcgaaggcgaccacctggactgatactgacactgaggtgcgaaagcgtggggagcaaacagg

SEQ ID NO: 2001 - DNA, 253 bp, Unknown
  Description of Unknown: bacterium polynucleotide
  Gammaproteobacteria; Pseudomonadaceae
tacagagggtgcaagcgttaatcggaattactgggcgtaaagcgcgcgtaggtggttcgttaagttggatgtgaaatccccgggctcaacctgggaactgcattcaaaactgtcgagctagagtatggcagagggtggtggaatttcctgtgtagcggggaaaggaggagatataggaaggaacaccagtggcgaaggcgaccacctggactgatactgacactgaggtgcgaaagcgtggggagcaaacagg

SEQ ID NO: 2002 - DNA, 253 bp, Unknown
  Description of Unknown: bacterium polynucleotide
  Gammaproteobacteria; Pseudomonadaceae
tacagagggtgcaagcgttaatcggaattactgggcgtaaagcgcgcgtaggcggtttgtcaagtcgaatgtgaaatccccgggctcaacctgggaactgcatccgaaactggcaagctagagtatggtagagggtggtggaatttcctgtgtagcggtgaaatgcgtagatataggaaggaacatcagtggcgaaggcgaccacctggaccaatactgacgctgaggtgcgaaagcgtggggagcaaacagg

SEQ ID NO: 2003 - DNA, 253 bp, Unknown
  Description of Unknown: bacterium polynucleotide
  Gammaproteobacteria; Pseudomonadaceae
tacgaagggtgcaagcgttaatcggaattactgggcgtaaagcgcgcgtaggtggcttgataagttggatgtaaaatccccgggctcaacctgggaactgcatccaaaactgtctggctagagtgcggtagagggtagtggaatttccagtgtagcggtgaaatgcgtagataggggaaggaacaccagtggcgaaggagaagaaagggaaggagaaggaaaaggaggggagaaagagtggggagaaaagagg

SEQ ID NO: 2004 - DNA, 253 bp, Pseudomonas sp.
  Gammaproteobacteria; Pseudomonadaceae; Pseudomonas
tacagagggtgcaagcgttaatcggaattactgggcgtaaagcgcgcgtaggtggcctggtaagttgaatgtgaaatccccgggctcaacctgggaactgcatccaaaactgcctggctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2005 - DNA, 253 bp, Pseudomonas sp.
  Gammaproteobacteria; Pseudomonadaceae; Pseudomonas
tacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2006 - DNA, 253 bp, Pseudomonas sp.
  Gammaproteobacteria; Pseudomonadaceae; Pseudomonas
tacagagggtgcaagcgttaatcggaattactgggcgtaaagcgcgcgtaggtggtttgccaagttgaatgtgaaatccccgggctcaacctgggaactgcatccaaaactggcaggctagagtatggtagagggtggtggaatttcctgtgtagcggtgaaatgcgtagatattggaaggaacaccagtggcgaaggcgactacctggactaacactgacactgaggtgcgaaagcgtggggagcaaacagg

SEQ ID NO: 2007 - DNA, 253 bp, Pseudomonas viridiflava
  Gammaproteobacteria; Pseudomonadaceae; Pseudomonas viridiflava
tacagagggtgcaagcgttagtcggaattactgggcgtaaagcgcgcgtaggtggttcgttaagttggatgtgaaagccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 2008 - DNA, 253 bp, Pseudomonas sp.
  Gammaproteobacteria; Pseudomonadaceae; Pseudomonas
tacagagggtgcgagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtaacggtgagatgcgtagatataggaaggaacaccagtggcgaaggcgaccacctggactgatactgacactgaggtgcgaaggcgtggagagcaaacagg

SEQ ID NO: 2009 - DNA, 253 bp, Pseudomonas sp.
  Gammaproteobacteria; Pseudomonadaceae; Pseudomonas
tacagagggtgcaagcgttaatcggaattactgggcgtaaagcgcgcgtaggtagttcgttaagttggatgtgaaagccccgggctcaacctgggaactgcattcaaaactgacgagctagagtatggtagagggtggtggaatttcctgtgtagcggtgaaatgcgtagacataggaaggaacaccagtggcgaaggcgaccacctggactgatactgacgctgaggtgcgaaagcgtggggatcaaacagg

SEQ ID NO: 2010 - DNA, 253 bp, Pseudomonas sp.
  Gammaproteobacteria; Pseudomonadaceae; Pseudomonas
tacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2011 - DNA, 253 bp, Pseudomonas veronii
  Gammaproteobacteria; Pseudomonadaceae; Pseudomonas veronii
tacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggcgcgagagcgtggggagcaaacagg

SEQ ID NO: 2012 - DNA, 251 bp, Pseudomonas sp.
  Gammaproteobacteria; Pseudomonadaceae; Pseudomonas
tacagagggtgcaagcgttaatcggaattactgggcgtaaagcgcgcaggcggtttgttaagttgaatgtgaaatccccgggctcagcctgggaactgcatccaaaactggcaagctagagtatggtagagggtggtggaatttcctgtgtagcggtgaaatgcgtagatataggaaggaacatcagtggcgaaggcgaccacctggaccaatactgacgctgaggtgcgaaagcgtagggagcaaacagg

SEQ ID NO: 2013 - DNA, 253 bp, Pseudomonas sp.
  Gammaproteobacteria; Pseudomonadaceae; Pseudomonas
tacggagggggctagcgttaatcggaattactgggcgtaaagcgcgcgtaggtggttcgttaagttggatgtgaaatccccgggctcaacctggggactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2014 - DNA, 253 bp, Pseudomonas sp.
  Gammaproteobacteria; Pseudomonadaceae; Pseudomonas
tacagagggtgcaagcgttaatcggaattactgggcgtaaagcgcgcgtaggtggttcagtaagttgaatgtggaatccccgggctcaacctgggaactgcatccaaaactgctgagctagagtatggtagagggtggtggaatttcctgtgtagcggtgaaatgcgtggatataggaaggaacaccagtggcgaaggcgaccacctggactgatactgacactgaggtgcgaaagcgtggggagcaaacagg

SEQ ID NO: 2015 - DNA, 253 bp, Pseudomonas sp.
  Gammaproteobacteria; Pseudomonadaceae; Pseudomonas
tacggagggtgcaagcgttaatcggaattactgggcgtaaagcgcgcgtaggtggttcgttaagttggatgtgaaatccccgggctcaacctgggaactgcattcaaaactgacgagctagagtatggtagagggcggtggaattccctgtgtagcggtgaaacgcgtagatataggaagggacaccagtggcgaaggcgaccacctggactgatactgacactgaggtgcgaaagcgtggggagcaaacggg

SEQ ID NO: 2016 - DNA, 253 bp, Pseudomonas umsongensis
  Gammaproteobacteria; Pseudomonadaceae; Pseudomonas umsongensis
tacagagggtgcaagcgttaatcggaattactgggcgtaaagcgcgcgtaggtggtttgttaagttggatgtgaaatccccgggctcaacctgggaactgcattcaaaactgactgactagagtgtggtagagggtggtggaatttcctgtgtagcggtgaaatgcgtagatataggaaggaatactaaatgagacggcgaccaccgagatctacactgacactgaggtgcgaaagcgtggggagcaaacagg

SEQ ID NO: 2017 - DNA, 253 bp, Pseudomonas sp.
  Gammaproteobacteria; Pseudomonadaceae; Pseudomonas
tacagagggtgcaagcgttaatcggaattactgggcgtaaagcgcgcgtaggtggttcggtaagttgaatgtgaaatccccgggctcaacctgggaactgcatccaaaactgccgagctagagtatggtagagggtggtgggatttcctgtgtagcggtgaaatgcgtagatataggaaggagcaccagtggcgaaggcgaccacctggactgatactaacattgaggtgcgaaagcgtggggagcaaacagg

SEQ ID NO: 2018 - DNA, 253 bp, Pseudomonas pseudoalcaligenes
  Gammaproteobacteria; Pseudomonadaceae; Pseudomonas pseudoalcaligenes
tacgaagggtgcaagcgttactcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgacttcctggaccaatactgacgctcaggcgcgaaagcgtggggagcaaacagg

SEQ ID NO: 2019 - DNA, 252 bp, Pseudomonas stutzeri
  Gammaproteobacteria; Pseudomonadaceae; Pseudomonas stutzeri
tacgaagggtgcaagcgttaatcggaattactgggcgtaaagcgcgcgtaggtggttcgttaagttggatgtgaagccccgggctcaacctgggaactgcatccaaaactggcgagctagagtatggcagagggtggtggaatttcctgtgtagcggtgaaatgcgtagatataggaaggaacaccagtgacgaaggcgaccacctgggctaatactgacgctgaggtgcgaaagcgtggggagcaaacagg

SEQ ID NO: 2020 - DNA, 253 bp, Pseudomonas sp.
  Gammaproteobacteria; Pseudomonadaceae; Pseudomonas
tacagagggtgcaagcgttaatcggaattactgggcgtaaagcgcgcgtaggtggttcagtaagatggaagtgaaatccccgggctcaacctgggaactgctttcataactgctgggctagagtacggtagagggtagtggaatttcctgtgtagcggtgaaatgcgtagatataggaaggaacaccagtggcgaaggcgactacctggactgatactgacactgaggtgcgaaagcgtggggagcaaacagg

SEQ ID NO: 2021 - DNA, 253 bp, Salinisphaera sp.
  Gammaproteobacteria; Salinisphaeraceae; Salinisphaera
tacggagggtgcaagcgttaatcggaattactgggcgtaaagcgagtgcaggcggtcgtgtgtgtcgggtgtgaaagccccgggctcaacctgggaattgcatccgaaactgcatggctagaatatggtagaggaagacggaattccacgtgtagcggtgaaatgcgtagatatgtggaggaacaccaatggcgaaggcagtcttctgggccaatattgacgctgaggctcgaaagcgtgggtagcaaacagg

SEQ ID NO: 2022 - DNA, 253 bp, Shewanella sp.
  Gammaproteobacteria; Shewanellaceae; Shewanella
tacggagggtccgagcgttaatcggaattactgggcgtaaagcgtgcgcaggcggtttgttaagcgagatgtgaaagccctgggctcaacctaggaatagcatttcgaactggcgaactagagtcttgtagaggggggtagaattccaggtgtagcggtgaaatgcgtagagatctggaggaataccggtggcgaaggcggccccctggacaaagactgacgctcatgcacgaaagcgtggggagcaaacagg

SEQ ID NO: 2023 - DNA, 253 bp, Unknown
  Description of Unknown: bacterium polynucleotide
  Gammaproteobacteria; Sinobacteraceae
tacagagggtgcgagcgttaatcggaattactgggcgtaaagcgtgcgtagacggttatttaagtcgggtgtgaaagccccgggctcaacctgggaattgcattcgagactgaatagctagggtacggtagagggaagtggaatttccggtgtagcggtgaaatgcgtagatatcggaaggaacatcagtggcgaaagcgacttcctggaccagtaccgacgttcaggcacgaaagcgtggggagcaaacagg

SEQ ID NO: 2024 - DNA, 253 bp, Unknown
  Description of Unknown: bacterium polynucleotide
  Gammaproteobacteria; Sinobacteraceae
tacagagggtgcaagcgttaatcggatttactgggcgtaaagcgtgtgtaggtggctgctcaagtcggttgtgaaatccccgggctcaacctgggaattgcttccgagactgagcgactagagtacggtagagggcggtggaatttccggtgtagcggtgaaatgcgtagatatcggaaggaacaccaatggcgaaggcagccgcctgggcctgtactgacactgagacacgaaagcgtggggatcaaacagg

SEQ ID NO: 2025 - DNA, 253 bp, Unknown
  Description of Unknown: bacterium polynucleotide
  Gammaproteobacteria; Sinobacteraceae
tacagagggtgcgagcgttaatcggaattactgggcgtaaagcgtgcgcagacggtcatgtaagtcgggtgtgaaagccccgggctcaacctgggaattgcattcgagactgcatggctagggtgcggaagagggaagcggaatttccggtgtagcggtgaaatgcgtagatatcggaaggaacaccagtggcgaaagcggcttcctggtccagcaccgacgttcaggcacgaaagcgtggggagcaaacagg

SEQ ID NO: 2026 - DNA, 253 bp, Unknown
  Description of Unknown: bacterium polynucleotide
  Gammaproteobacteria; Sinobacteraceae
tacagagggtgcgagcgttaatcggaattactgggcgtaaagcgcgcgtagacggttttgtaagtcagatgtgaaatccctgggctcaacctgggaactgcatttgaaactgcatggctagagtatcgaagagggaagtggaatttccggtgtagcggtgaaatgcgtagatatcggaaggaacaccagtggcgaaagcgacttcctggtcgaatactgacgttcatgtgcgaaagcgtggggagcaaacagg

SEQ ID NO: 2027 - DNA, 253 bp, Unknown
  Description of Unknown: bacterium polynucleotide
  Gammaproteobacteria; Sinobacteraceae
tacagagggtgcaagcgttaatcggaattactgggcgtaaagcgtgcgtagacggttatgtaagtcagatgtgaaagccccgggcttaacctgggaatggcatttgagactgcatagctagggtgcggaagagggaagcggaatttccggtgtagcggtgaaatgcgtagatatcggaaggaacaccagtggcgaaagcggcttcctggtccagcaccgacgttcaggcacgaaagcgtggggagcaaacagg

SEQ ID NO: 2028 - DNA, 253 bp, Unknown
  Description of Unknown: bacterium polynucleotide
  Gammaproteobacteria; Sinobacteraceae
tacagagggtgcaagcgttaatcggatttactgggcgtaaagcgtgtgtaggtggcttcttaagtcggttgtgaaagccctgggctcaacctgggaattgcagtcgatactgagaagctcgagttcggtagagggtgacggaattcccggtgtagcggtgaaatgcgtagatatcgggaggaacatcgatggcgaaggcaatcacctgggcctgaactgacactgtgacgcgaaagcgtgggtagcaaacagg

SEQ ID NO: 2029 - DNA, 253 bp, Unknown
  Description of Unknown: bacterium polynucleotide
  Gammaproteobacteria; Sinobacteraceae
tacagagggtgcgagcgttaatcggaattactgggcgtaaagcgtgcgtagacggttttgtaagtcggatgtgaaatccccgggctcaacctgggaattgcattcgagactgcaaggcttgggtgcggaagagggaagcggaatttccggtgtagcggtgaaatgcgtagatatcggaaggaacatcagtggcgaaagcggcttcctggtccagcaccgacgttcaggcacgaaagcgtggggagcaaacagg

SEQ ID NO: 2030 - DNA, 253 bp, Unknown
  Description of Unknown: bacterium polynucleotide
  Gammaproteobacteria; Sinobacteraceae
tacgtagggtgcaagcgttaatcggaattactgggcgtaaagcgtgcgtagacggttacataagtcgggtgtgaaagccccgggctcaacctgggaattgcattcgagactgcgtagctagggtgcggaagagggaagcggaatttccggtgtagcggtgaaatgcgtagatatcggaaggaacaccagtggcgaaagcggcttcctggtccagcaccgacgttcaggcacgaaagcgtggggagcaaacagg

SEQ ID NO: 2031 - DNA, 253 bp, Unknown
  Description of Unknown: bacterium polynucleotide
  Gammaproteobacteria; Sinobacteraceae
tacagagggtgcaagcgttaatcggaattactgggcgtaaagcgtgcgtagacggtagcgtaagtcgggtgtgaaagccccgggctcaacctgggaattgcattcgagactgctctgctagggtgcggaagaggggagcggaatttccggtgtagcggtgaaatgcgtagatatcggaaggaacaccagtggcgaaagcggctccctggtccagcaccgacgttcaggcacgaaagcgtggggagcaaacagg

SEQ ID NO: 2032 - DNA, 253 bp, Unknown
  Description of Unknown: bacterium polynucleotide
  Gammaproteobacteria; Sinobacteraceae
tacagagggtgcaagcgttaatcggatttactgggcgtaaagcgtgtgtaggttgtttgacaagtcggttgtgaaatccccgggctcaacctgggaactgcttccgagactgtccgactagagtacggtagagggcggtggaatttccggtgtagcggtgaaatgcgtagatatcggaaggaacaccaatggcgaaggcagccgcctgggcctgtactgacactgagacacgaaagcgtggggatcaaacagg

SEQ ID NO: 2033 - DNA, 253 bp, Unknown
  Description of Unknown: bacterium polynucleotide
  Gammaproteobacteria; Sinobacteraceae
tacagagggtgcaagcgttaatcggaattactgggcgtaaagcgtgcgtagacggttacgtaagtcgggtgtgaaagccccgggctcaacctgggaattgcgttcgagactgcatagctagggtgcggaagagggaagcggaatttcgggtgtagcggtgaaatgcgtagatatccgaaggaacatcagtggcgaaagcggcttcctggtccagcaccgacgttcaggcacgaaagcgtggggagcaaacagg

SEQ ID NO: 2034 - DNA, 253 bp, Unknown
  Description of Unknown: bacterium polynucleotide
  Gammaproteobacteria; Sinobacteraceae
tacagagggtgcaagcgttaatcggatttactgggcgtaaagcgtgcgtaggcggttcattaagtcggttgtgaaatccctgggcttaacctgggaactgcagtcgatactggtggactagagtgcggtagagggtggcggaactccgggtgtagcggtgaaatgcgtagatatccggaagaacaccgatggcgaaggcaaccacctgggcctgcactgacgcagaggtacgaaagcgtggggagcaaacagg

SEQ ID NO: 2035 - DNA, 253 bp, Unknown
  Description of Unknown: bacterium polynucleotide
  Gammaproteobacteria; Sinobacteraceae
tacagagggtgcgagcgttaatcggatttactgggcgtaaagcgtgtgtaggtggcttcctaagtcggttgtgaaatccctgggctcaacctgggaattgcagtcgatactgggaagctcgagttcggtagaggacggcggaattcccggtgtagcggtgaaatgcgtagatatcgggaggaacatcgatggcgaaagcaaccgtctgggcctgaactgactctgagacacgaaagcgtggggagcaaacagg

SEQ ID NO: 2036 - DNA, 253 bp, Unknown
  Description of Unknown: bacterium polynucleotide
  Gammaproteobacteria; Sinobacteraceae
tacagagggtgcaagcgttaatcggaattactgggcgtaaagcgtgcgtagtcggttatttaagtcgggtgtgaaatccccgggctcaacctgggaattgcattcgatactggatagctagagttcggcagagggaagcggaatttccggtgtagcggtgaaatgcgtagatatcggaaggaacatcagtggcgaaagcggcttcctggaccagaactgacgatcaggcacgaaagcgtggggagcaaacagg

SEQ ID NO: 2037 - DNA, 253 bp, Unknown
  Description of Unknown: bacterium polynucleotide
  Gammaproteobacteria; Sinobacteraceae
tacagagggtgcaagcgttaatcggaattactgggcgtaaagcgtgcgcagacggttatataagtcgggtgtgaaagccccgggctcaacctgggaattgcattcgagactgtgtagctagggtacggaagagggaagcggaatttcaggtgtagcggtgaaatgcgtagatatctgaaggaacaccagtggcgaaagcggcttcctggtccagtaccgacgttcaggcacgaaagcgtggggagcaaacagg

SEQ ID NO: 2038 - DNA, 253 bp, Unknown
  Description of Unknown: bacterium polynucleotide
  Gammaproteobacteria; Sinobacteraceae
tacagagggtgcgagcgttaatcggaattactgggcgtaaagcgcacgtagtcggctttgcaagtcgggtgtgaaatccccgggctcaacctgggaactgcatccgagactgcattgctagagtatgggagagggaagcggagtttctggtgtagcagtgaaatgcgtagatatcagaaggaacatcagtggcgaaggcggcttcctggaccaatactgacgatcaggtgcgaaagcgtggggagcaaacagg

SEQ ID NO: 2039 - DNA, 253 bp, Unknown
  Description of Unknown: bacterium polynucleotide
  Gammaproteobacteria; Sinobacteraceae
tacagagggtgcgagcgttaatcggatttactgggcgtaaagcgtgtgtaggtggttattcaagtcggttgtgaaatccccgggctcaacctgggaactgcttccgagactgaaagactagagtacggtagagggtggtggaatttccggtgtagcggtgaaatgcgtagatatcggaaggaacatcaatggcgaaggcagccacctgggcctgtactgacactgagacacgaaagcgtggggatcaaacagg

SEQ ID NO: 2040 - DNA, 253 bp, Steroidobacter sp.
  Gammaproteobacteria; Sinobacteraceae; Steroidobacter
tacagagggtgcgagcgttaatcggaattactgggcgtagagcgcgcgtaggcggcttttcaagtcgattgtgaaatccccgggcttaacctgggaactgcagtcgagactgtcttgctagagtatgggagagggaagtggaatttcaggtgtagcggtgaaatgcgtagatatctgaaggaacatcggtggcgaaagcgacttcctggaccaatactgacgctcatgtgcgaaagcgtggggaacaaacagg

SEQ ID NO: 2041 - DNA, 253 bp, Steroidobacter sp.
  Gammaproteobacteria; Sinobacteraceae; Steroidobacter
tacagagggtgcgagcgttaatcggaattactgggcgtaaagcgcgcgtaggcggcttttcaagtcggatgtgaaatccccgggctcaacctgggaactgcattcgagactgtctagctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacagg

SEQ ID NO: 2042 - DNA, 253 bp, Steroidobacter sp.
  Gammaproteobacteria; Sinobacteraceae; Steroidobacter
tacagagggtgcgagcgttaatcggaattactgggcgtaaagcgcacgtaggtggctttgcaagtcgattgcgaaatccccgggctcaacctgggaactgcagtcgagactgcttagctcgagtatgggagagggaggtggaatttccggtgtagcggtgaaatgcgtagatatcggaaggaacatcagtggcgaaagcgacctcctggaccaatactgacactcaagtgcgaaagcgtggggagcaaacagg

SEQ ID NO: 2043 - DNA, 253 bp, Steroidobacter sp.
  Gammaproteobacteria; Sinobacteraceae; Steroidobacter
tacagagggtgcgagcgttaatcggaattactgggcgtaaagcgcgcgtaggcggctttgcaagtcgggtgtgaaatccccaggcttaacctgggaactgcattcgagactgcattgctagagtatgggagagggaagtggaatttccggtgtagcggtgaaatgcgtagatatcggaaggaacatcagtggcgaaagcgacttcctggaccaatactgacgctcatgtgcgaaagcgtggggagcaaacagg

SEQ ID NO: 2044 - DNA, 253 bp, Steroidobacter sp.
  Gammaproteobacteria; Sinobacteraceae; Steroidobacter
tacagagggcgcgagcgttaatcggaattactgggcgtaaagcgcgcgtaggcggctttgcaagtcgggtgtgaaatccctgggcttaacctaggaactgcactcgagactgcattgctagagtatggtagagggaagtggaatttccggtgtagcggtgaaatgcgtagatatcggaaggaacaccagtggcgaaagcgacttcctggaccaatactgacgcccaggcgcgaaagcgtggggagcaaacagg

SEQ ID NO: 2045 - DNA, 253 bp, Steroidobacter sp.
  Gammaproteobacteria; Sinobacteraceae; Steroidobacter
tacagagggtgcgagcgttaatcggaactactgggcgtaaagcgcgcgtaggcggcttttcaagccgattgtgaaatccccgggcttaacctgggaactgcggtcgggactgtctagctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacagg

SEQ ID NO: 2046 - DNA, 253 bp, Unknown
  Description of Unknown: bacterium polynucleotide
  Gammaproteobacteria; Xanthomonadaceae
tacgaagggtgcgagcgttactcggaattactgggcgtaaagggtgcgtaggtggtttgttaagtctgctgtgaaatccccgggctcaacctgggaatggcagtggatactggcaagctagagtgcggtagagggtagtggaattcccggtgtagcagtgaaatgcgtagagatcgggaggaacaccagtggcgaaggcggctacctggaccagcactgacactgaagcacgaaagcgtggggagcaaacagg

SEQ ID NO: 2047 - DNA, 253 bp, Unknown
  Description of Unknown: bacterium polynucleotide
  Gammaproteobacteria; Xanthomonadaceae
tacgaagggggctagcgttgttcggaattactgggcgtaaagcgagtgtaggtggttgttcaagttggatgtgaaagccttgagctcaactcaagaaatgcattcaggactgagcgactagaggaccggagaggatagtggaattcccagtgtagtggtgaaatgcgtagagatcgggaggaacatctgtggcgaaggcggccatctggaccagcactgacactgaggcacgaaagcgtggggagcaaacagg

SEQ ID NO: 2048 - DNA, 253 bp, Unknown
  Description of Unknown: bacterium polynucleotide
  Gammaproteobacteria; Xanthomonadaceae
tacgaagggtgcaagcgttaatcggaattaccgggcgtaaagcgtgcgtaggtggttggttaagtctgtcgtgaaagccctgggctcaacctgggaatggcgatggatactggccgactagagtgcggtagagggtagcggaatttccggtgtagcggtgaaatgcgtagagatcggaaggaacatccgtggcgaaggcggctacctggaccagcactgacactgaggcacgaaagcgtggggagcaaacagg

SEQ ID NO: 2049 - DNA, 253 bp, Unknown
  Description of Unknown: bacterium polynucleotide
  Gammaproteobacteria; Xanthomonadaceae
tacgaagggtgcaagcgttaatcggaattactgggcgtaaagcgtgcgtaggcggtttcttaagcccgttgtgaaagccctgggctcaacctgggaactgcgatggatactgaggagctggagtacggtagaggaaggtggacttcccggtgtagcggtgaaatgcgtagagatcgggaggaacatcagtggcgaaggcggccttctggaccagtactgacgctgaggcacgaaagcgtggggagcaaacagg

SEQ ID NO: 2050 - DNA, 253 bp, Unknown
  Description of Unknown: bacterium polynucleotide
  Gammaproteobacteria; Xanthomonadaceae
tacgaagggtgcaagcgttactcggaattactgggcgtaaagcgtgcgtaggtggttttttaagtccgttgtgaaagccctgggctcaacctgggaatggcagtggatactggaaagctagagtgcggtagagggtagtggaattcccggtgtagcagtgaaatgcgtagagatcgggaggaacaccagtggcgaaggcggctacctggaccagcactgacactgaggcacgaaagcgtggggagcaaacagg

SEQ ID NO: 2051 - DNA, 253 bp, Unknown
  Description of Unknown: bacterium polynucleotide
  Gammaproteobacteria; Xanthomonadaceae
tacgaagggtgcaagcgttactcggaattactgggcgtaaagggtgcgtaggtggtcgtttaagtccgttgtgaaatccctgggctcaacctgggaatggcagtggatactggacggctagaatgcggtagagggtagtggaattcccggtgtagcagtgaaatgcgtagagatcgggaggaacaccagtggcgaaggcggctacctggaccagcattgacactcaagcacgaaagcgtggggagcaaacagg

SEQ ID NO: 2052 - DNA, 253 bp, Unknown
  Description of Unknown: bacterium polynucleotide
  Gammaproteobacteria; Xanthomonadaceae
tacgaagggtgcaagcgttactcggaattactgggcgtaaagcgtgcgtaggtggtttgctaagtctgtcgtgaaatccccgggctcaacctgggaatggcgatggatactggcaagctagagtgaggtagaggagagtggaattcccggtgtagcagtgaaatgcgtagagatcgggaggaacatcagttgcgaaggcggctctctggaccatcactgacactgaggcacgaaagcgtggggagcaaacagg

SEQ ID NO: 2053 - DNA, 253 bp, Unknown
  Description of Unknown: bacterium polynucleotide
  Gammaproteobacteria; Xanthomonadaceae
tacgaagggtgcaagcgttactcggaattactgggcgtaaagcgtgcgtaggcggtggtttaagtctgatgtgaaatccccgggctcaacctgggaatggcattggatactggatcgctagagtacggtagagggtggtggaattcccggtgtagcagtgaaatgcgtagagatcgggaggaacatctgtggcgaaggcggccacctggaccagtactgacgctgaggcacgaaagcgtggggagcaaacagg

SEQ ID NO: 2054 - DNA, 253 bp, Unknown
  Description of Unknown: bacterium polynucleotide
  Gammaproteobacteria; Xanthomonadaceae
tacagagggtgcaagcgttaatcggaattactgggcgtaaagcgtgcgtaggcggttcgttaagtctgtcgtgaaagccctgggctcaacctgggaatggcgatggatactggcgagctagagtgtgatagaggatggcggaattcccggtgtagcggtgaaatgcgtagagatcgggaggaacatccgtggcgatggcggccatctggatcaacactgacgctgaggcacgaaagcgtggggagcaaacagg

SEQ ID NO: 2055 - DNA, 253 bp, Unknown
  Description of Unknown: bacterium polynucleotide
  Gammaproteobacteria; Xanthomonadaceae
tacgaagggtgcaagcgttactcggaattactgggcgtaaagcgtgcgtaggtggttcgttaagtccgatgtgaaagccctgggctcaacctgggaatggcattggatactggcgggctagagtgcggtagaggatagtggaattcctggtgtagcagtgaaatgcgtagagatcaggaggaacatccgtggcgaaggcgactgtctggaccagcactgacactgaggcacgaaagcgtggggagcaaacagg

SEQ ID NO: 2056 - DNA, 253 bp, Unknown
  Description of Unknown: bacterium polynucleotide
  Gammaproteobacteria; Xanthomonadaceae
tacgaagggtgcaagcgttactcggaattactgggcgtaaagcgtgagtaggtggtttcttaagtctgctgtggaagccccgggctcaacctgggaattgcagtggatactgggaagctagagtgcggtagagggtagtggaattcccggtgtagcggtgaaatgcgtagagatcgggaggaacaccagtggcgaaggcggctacctggaccagcactgacactgagtcacgaaagcgtggggagcaaacagg

SEQ ID NO: 2057 - DNA, 253 bp, Unknown
  Description of Unknown: bacterium polynucleotide
  Gammaproteobacteria; Xanthomonadaceae
tacgaagggtgcaagcgttactcggaactactgggcgtaaagcgtgcgtaggtggtgagttaagtctgatgtgaaatccccgggctcaacctgggaatggcattggatactggctcgctagagtgcggtagagggtggtggaattcccggtgtagcagtgaaatgcgtagagatcgggaggaacatctgtggcgaaggcggccacctggaccagcactgacactgaggcacgaaagcgtggggagcaaacagg

SEQ ID NO: 2058 - DNA, 253 bp, Unknown
  Description of Unknown: bacterium polynucleotide
  Gammaproteobacteria; Xanthomonadaceae
tacgaagggtgcaagcgttaatcggaattactgggcgtaaagcgtgcgtaggcggttggctaagtcagatgtgaaagccctgggctcaacctgggaatggcatttgaaactggctggctagagtgtgatagaggatggcggaattcccggtgtagcggtgaaatgcgtagagatcgggaggaacatccgtggcgaaggcggccatctggatcaacactgacgctgaggcacgaaagcgtggggagcaaacagg

SEQ ID NO: 2059 - DNA, 253 bp, Unknown
  Description of Unknown: bacterium polynucleotide
  Gammaproteobacteria; Xanthomonadaceae
tacgaagggtgcaagcgttaatcggaattactgggcgtaaagcgtgcgtaggcggtttgttaagtccgatgtgaaagccctgggctcaacctgggaatggcactggatactggcaggctagaatgtggtagaggggtgcggaatttccggtgtagcggtgaaatgcgtagagatcggaaggaacatccgtggcgaaggcggcaccctggaccaacattgacgctgaggcacgaaagcgtggggagcaaacagg

SEQ ID NO: 2060 - DNA, 254 bp, Unknown
  Description of Unknown: bacterium polynucleotide
  Gammaproteobacteria; Xanthomonadaceae
tatgtagggcgcaagcgttatccggaattattgggcgtaaagagctcgtaggcggctcaataagtcgggtgtgaaacccccaggctcaacctggggacgccacccgatactgttgtggctagagtccagtaggggagtgtggaattcccggtgtagcagtgaaatgcgaagagatcgggaggaacatctgtggcgaaggcggccacctggaccagcactgacactgaggcacgaaagcgtggggagcaaacagg

SEQ ID NO: 2061 - DNA, 253 bp, Arenimonas oryziterrae
  Gammaproteobacteria; Xanthomonadaceae; Arenimonas oryziterrae
tacgaagggtgcaagcgttactcggaattactgggcgtaaagcgtgcgtaggtggtgcgttaagtctgtcgtgaaagccccgggctcaacctgggaatggcgatggatactggcgcgctagagtgcggtagaggagagtggaattcccggtgtagcagtgaaatgcgtagagatcgggaggaacatcagttgcgaaggcggctctctggaccagcactgacactgaggcacgaaagcgtggggagcaaacagg

SEQ ID NO: 2062 - DNA, 253 bp, Arenimonas sp.
  Gammaproteobacteria; Xanthomonadaceae; Arenimonas
tacgaagggtgcaagcgttactcggaattactgggcgtaaagcgtgcgtaggtggttcgttaagtctgccgtgaaagccccgggctcaacctgggaatggcggtggatactggcggactagagtgcggtagagggtggtggaattcccggtgtagcagtgaaatgcgtagagatcgggaggaacatctgtggcgaaggcggccacctggaccagcactgacactgaggcacgaaagcgtggggagcaaacagg

SEQ ID NO: 2063 - DNA, 253 bp, Dokdonella sp.
  Gammaproteobacteria; Xanthomonadaceae; Dokdonella
tacgaagggtgcaagcgttactcggtatcactgggcataaagcgtgcgtaggcggttcgttgagtctgctgtgaaagccctgggctcaacctgggaactgcagtggatactggcgggctagagtgtgatagaggatggtggaattcccggagtagcggtgaaatgcgtagagatcgggaggaacaccagtggcgaaggcggccatctggatcaacactgacgctgaggcacgaaagcgtggggagcaaacagg

SEQ ID NO: 2064 - DNA, 253 bp, Dokdonella sp.
  Gammaproteobacteria; Xanthomonadaceae; Dokdonella
tacgaagggtgcaagcgttactcggaattactgggcgtaaagcgtgcgtaggcggtttgttaagtctgtcgtgaaagccctgggctcaacctgggaattgcgatggatactggtaagctagagtacggtagaggatggtggaattcccggtgtagcggtgaaatgcgtagagatcgggaggaactcccgtggcgaaggcggccatctggaccagtactgacgctgtggcacgaaagcgtggggagcaaacagg

SEQ ID NO: 2065 - DNA, 253 bp, Dokdonella sp.
  Gammaproteobacteria; Xanthomonadaceae; Dokdonella
tacgaagggtgcaagcgttactcggaattactgggcgtaaagcgtgcgtaggcggttggttaagtctgctgtgaaagccctgggctcaacctgggaactgcagtggatactggccagctagagtgtgtcagaggatggtggaattcccggtgtagcggtgaaatgcgtagagatcgggaggaacaccagtggcgaaggcggccatctgggacaacactgacgctgaggcacgaaagcgtggggagcaaacagg

SEQ ID NO: 2066 - DNA, 253 bp, Dokdonella sp.
  Gammaproteobacteria; Xanthomonadaceae; Dokdonella
tacgaagggtgcaagcgttactcggaattactgggcgtaaagcgtgcgtaggcggtttgttaagtccgctgtgaaagccctgggctcaacctgggaattgcagtggatactggcaagctagagtgcggtagaggatggtggaattcccggtgtagcggtgaaatgcgtagagatcgggaggaacacccgtggcgaaggcggccatctggaccagcactgacgctgaggcacgaaagcgtggggagcaaacagg

SEQ ID NO: 2067 - DNA, 253 bp, Dokdonella sp.
  Gammaproteobacteria; Xanthomonadaceae; Dokdonella
tacgaagggtgcaagcgttactcggaatcactgggcgtaaagcgtgcgtaggcggttcgttaagtctgctgtggaagccctgggctcaacctgggaactgcagtggatactggcgaactagagtgtgatagaggatggtggagttcccggtgtagcggtgaaatgcgtagagatcgggaggaacaccagtggcgaaggcggccatctggatcaacactgacgctgaggcacgaaagcgtggggagcaaacagg

SEQ ID NO: 2068 - DNA, 253 bp, Dokdonella sp.
  Gammaproteobacteria; Xanthomonadaceae; Dokdonella
tacgaagggtgcaagcgttagtcggaattactgggcgtaaagcgtgcgtaggcggtctcttaagtccgttgtgaaagccctgggctcaacctgggaactgcagtggatactgagaagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacagg

SEQ ID NO: 2069 - DNA, 252 bp, Dyella sp.
  Gammaproteobacteria; Xanthomonadaceae; Dyella
tacgaagggtgcaagcgttaatcggaattactgggcgtaaagggtgcgtaggcggttatttaagtctgctgtgaaatccccgggctcaacctgggaatggcagtggatactggatagctagagtgtgtcagaggatggtggaattcccggtgtagcggtgaaatgcgtagagatcgggaggaacatcagtggcggaggcgacacgctgggccgtactgacgctgaagcacgaaagcgtggggagcaaacagg

SEQ ID NO: 2070 - DNA, 253 bp, Ignatzschineria sp.
  Gammaproteobacteria; Xanthomonadaceae; Ignatzschineria
tacggagggtgcaagcgttaatcggaattactgggcgtaaagggcgcgtaggtggtatcttaagttgggtgtgaaatccccgggctcaacctgggaattgcatcaaaaactggggtgctagagtatggtagagggtagcggaatttctggtgtagcggtgaaatgcgtagatatcagaaggaacatcaatggcgaaggcagctacctgggccaatactgacgctgaggcgcgaaagcatggggagcaaacagg

SEQ ID NO: 2071 - DNA, 253 bp, Luteibacter rhizovicinus
  Gammaproteobacteria; Xanthomonadaceae; Luteibacter rhizovicinus
tacgaagggtgcaagcgttaatcggaattactgggcgtaaagcgtgcgtaggcggtttgttaagtctgttgtgaaatccccgggctcaacctgggaatggcaatggatactggcaagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacagg

SEQ ID NO: 2072 - DNA, 253 bp, Luteimonas sp.
  Gammaproteobacteria; Xanthomonadaceae; Luteimonas
tacgaagggtgcaagcgttactcggaattactgggcgtaaagcgtgcgtaggtggttcgttaagtctgatgtgaaagccctgggctcaacctgggaattgcattggatactggcgggctagagtgcggtagaggatggcggaattcccggtgtagcagtgaaatgcgtagagatcgggaggaacatctgtggcgaaggcggccatctggaccagcactgacactgaggcacgaaagcgtggggagcaaacagg

SEQ ID NO: 2073 - DNA, 253 bp, Luteimonas sp.
  Gammaproteobacteria; Xanthomonadaceae; Luteimonas
tacgaagggtgcaagcgttactcggaattactgggcgtaaagcgtgcgtaggtggttcgttaagtctgatgtgaaagccccgggctcaacctgggaattgcattggatactggcgggctagagtacggtagagggtggcggaattcctggtgtagcagtgaaatgcgtagagatcaggaggaacatccgtggcgaaggcggccacctggaccagtactgacactgaggcacgaaagcgtggggagcaaacagg

SEQ ID NO: 2074 - DNA, 253 bp, Lysobacter sp.
  Gammaproteobacteria; Xanthomonadaceae; Lysobacter
tacgaagggtgcaagcgttactcggaattactgggcgtaaagcgtgcgtaggtggtttgttaagtctgatgtgaaagccctgggctcaacctgggaatggcattggaaactggcttactagagtgcggtagagggtagtggaattcccgatgtagcagtgaaatgcgtagatatcgggaggaacatctgtggcgaaggcgactacctggaccagcactgacactgaggcacgaaagcgtggggagcaaacagg

SEQ ID NO: 2075 - DNA, 253 bp, Lysobacter sp.
  Gammaproteobacteria; Xanthomonadaceae; Lysobacter
tacgaagggtgcaagcgttactcggaattactgggcgtaaagcgtgcgtaggtggttcgttaagtctgatgtgaaagccctgggctcaacctgggaatggcattggatactggcgacctagagtgcggtagaggggtgtggaattcccggtgtagcagtgaaatgcgtagatatcgggaggaacatctgtggcgaaggcgacaccctggaccagcactgacactgaggcacgaaagcgtggggagcaaacagg

SEQ ID NO: 2076 - DNA, 253 bp, Lysobacter sp.
  Gammaproteobacteria; Xanthomonadaceae; Lysobacter
tacgaagggtgcaagcgttactcggaattactgggcgtaaagcgtgcgtaggtggtttgttatgtctgatgtgaaagccccgggctcaacctgggaatggcattggatactggcagtctagagtgcggtagagggtagtggaattcccggtgtagcagtgaaatgcgtagatatcgggaggaacatccgtggcgaaggcgactacctggaccagcactgacactgaggcacgaaagcgtggggagcaaacagg

SEQ ID NO: 2077 - DNA, 253 bp, Lysobacter sp.
  Gammaproteobacteria; Xanthomonadaceae; Lysobacter
tacgaagggtgcaagcgttactcggaattactgggcgtaaagcgtgcgtaggtggttcgttaagtctgatgtgaaagccctgggctcaacctgggaactgcattggatactggcgatctggagtgcggtagagggtggcggaattcccggtgcagcagtgaaatgcgtagatatcgggaggaacatccgtggcgaaggcggccacctggactagcactgacactgaggcacgaaagcgtggggagcaaacagg

SEQ ID NO: 2078 - DNA, 253 bp, Pseudoxanthomonas sp.
  Gammaproteobacteria; Xanthomonadaceae; Pseudoxanthomonas
tacgaagggtgcaagcgttactcggaattactgggcgtaaagcgtgcgtaggtggttgtttaagtctgtcgtgaaagccctgggctcaacctgggaattgcgatggatactgggcgactagagtgtggtagagggatgtggaatttccggtgtagcagtgaaatgcgtagagatcggaaggaacatctgtggcgaaggcgacatcctgggccaacactgacactgaggcacgaaagcgtggggagcaaacagg

SEQ ID NO: 2079 - DNA, 253 bp, Pseudoxanthomonas indica
  Gammaproteobacteria; Xanthomonadaceae; Pseudoxanthomonas indica
tacgaagggtgcaagcgttactcggaattactgggcgtaaagcgtgcgtaggtggtggtttaagtctgctgtgaaagccctgggctcaacctgggaattgcagtggatactgggtcactagagtgtggtagagggatgcggaatttccggtgtagcagtgaaatgcgtagagatcggaaggaacatccgtggcgaaggcggcaccctgggccaacactgtcactggggcacgaaagcgtggggagcaaacagg

SEQ ID NO: 2080 - DNA, 253 bp, Pseudoxanthomonas mexicana
  Gammaproteobacteria; Xanthomonadaceae; Pseudoxanthomonas mexicana
tacgaagggtgcaagcgttactcggaattactgggcgtaaagcgtgcgtaggtggtggtttaagtctgctgtgaaagccctgggctcaacctggggattgcagtggatactggatcactagagtgtggtagagggatgcggaatttctggtgtagcagtgaaatgcgtagagatcagaaggaacatccgtggcgaaggcggcatcctgggccagcactgacactgaggcacgaaagcgtggggagcaaacagg

SEQ ID NO: 2081 - DNA, 253 bp, Pseudoxanthomonas sp.
  Gammaproteobacteria; Xanthomonadaceae; Pseudoxanthomonas
tacgaagggtgcaagcgttactcggaattactgggcgtaaagcgtgcgtaggtggttgtttaagtctgttgtgaaagccctgggctcaacctgggaattgcagtggatactgggcgactagagtgtggtagaggatagtggaatttccggtgtagcagtgaaatgcgtagagatcggaaggaacatctgtggcgaaggcgactatctgggccaacactgacactgaggcacgaaagcgtggggagcaaacagg

SEQ ID NO: 2082 - DNA, 253 bp, Pseudoxanthomonas taiwanensis
  Gammaproteobacteria; Xanthomonadaceae; Pseudoxanthomonas taiwanensis
tacgaagggtgcaagcgttactcggaattactgggcgtaaagcgtgcgtaggtggtggcttaagtccgttgtgaaagccctgggctcaacctgggaattgcagtggatactgggtcactggagtgtggtagagggtggcggaattcccggtgtagcagtgaaatgcgtagagatcgggaggaacacccgtggcgaaggcggccacctgggccaacactgacactgaggcacgaaagcgtggggagcaaacagg

SEQ ID NO: 2083 - DNA, 253 bp, Rhodanobacter sp.
  Gammaproteobacteria; Xanthomonadaceae; Rhodanobacter
tacgaagggtgcaagcgttaatcggaattactgggcgtaaagggtgcgtaggcggttatttaagtctgctgtgaaatccccgggctcaacctgggaatggcagtggatactggatagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 2084 - DNA, 253 bp, Rhodanobacter sp.
  Gammaproteobacteria; Xanthomonadaceae; Rhodanobacter
tacgaagggtgcaagcgttaatcggaattactgggcgtaaagggtgcgtaggcggttcgttaagtctgtcgtgaaatccccgggctcaacctgggaatggcgatggatactggcgagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 2085 - DNA, 253 bp, Stenotrophomonas sp.
  Gammaproteobacteria; Xanthomonadaceae; Stenotrophomonas
tacgaagggtgcaagcgctactcggaattactgggcgtaaagcgtgcgtaggtggttgtttaagtctgttgtgaaggccctgggctcaacctggggactgcagtggaaactggatgactagagtgtggtagagggtagcggaattcccggtgtagcagtgaaatgcgtagagatcgggaggaacatccatggcgaaggcagctacctggaccaacactgacactgaggcacgaaagcgtggggagcaaacagg

SEQ ID NO: 2086 - DNA, 253 bp, Thermomonas sp.
  Gammaproteobacteria; Xanthomonadaceae; Thermomonas
tacggagggtgcaagcgttactcggaattactgggcgtaaagcgtgcgtaggtggtctgttaagtctgatgtgaaagccctgggctcaacctgggaattgcattggatactggcaggctagagtgcggtagggggtagtggaattcccggtgtagcagtgaaatgcgtagagatcgggaggaacaccagtggcgaaggcgactacctggaccagcactgacactgaggcacgaaagcgtggggagcaaacagg

SEQ ID NO: 2087 - DNA, 253 bp, Thermomonas sp.
  Gammaproteobacteria; Xanthomonadaceae; Thermomonas
tacgaagggtgcaagcgttactcggaattactgggcgtaaagcgtgcgtaggtggtttgttaagtctgatgtgaaagccctgggctcaacctgggaatagcattggatactggcgagctagagtgcggtagagggcagtggaattcccggtgtagcagtgaaatgcgtagagatcgggaggaacatctgtggcgaaggcgactgcctggaccagcactgacactgaggcacgaaagcgtggggagcaaacagg

SEQ ID NO: 2088 - DNA, 253 bp, Thermomonas sp.
  Gammaproteobacteria; Xanthomonadaceae; Thermomonas
tacgaagggtgcaagcgttactcggaattactgggcgtaaagcgtgcgtaggtggtctgttaagtctgatgtgaaagccctgggctcaacctgggaatggcattggaaactggcgggctagagtgcggtagagggtagtggaattcccggtgtagcagtgaaatgcgtagagatcgggaggaacattcgtggcgaaggcggctacctggaccagcactgacactgaggcacgaaagcgtggggagcaaacagg

SEQ ID NO: 2089 - DNA, 253 bp, Xanthomonas axonopodis
  Gammaproteobacteria; Xanthomonadaceae; Xanthomonas axonopodis
tacgaagggtgcaagcgttactcggaattactgggcgtaaagcgtgcgtaggtggtggtttaagtctgttgtgaaagccctgggctcaacctgggaattgcagtggatactggatcactagagtgtggtagagggtagcggaattcccggtgtagcagtgaaatgcgtagagatcgggaggaacatccgtggcgaaggcggctacctggaccaacactgacactgaggcacgaaagcgtggggagcaaacagg

SEQ ID NO: 2090 - DNA, 254 bp, Unknown
  Description of Unknown: bacterium polynucleotide
  Gemm-1
tacggagggtgcgagcgttgtccggaatcactgggcgtaaagggcgcgtatgcggcctgataagtaggggggtgaagtcctgcggcttaaccgcagggctgccttctaaactgtcaggctcgagcacagtagaggcaggtggaattcccggtgtagcggtggaatgcgtagagatcgggaagaacatcagtggcgaaggcggcctgctgggctgttgctgacgctgaggcgcgacagcgtggggagcaaacagg

SEQ ID NO: 2091 - DNA, 253 bp, Unknown
  Description of Unknown: bacterium polynucleotide
  Gemm-1
tacggagggtgcgagcgttgtccggaatcactgggcgtaaagggcgcgtaggcggcctgataagtagggggtgaaatcttgcggcttaaccgcaaggctgccttctaaactgtcgggctcgagcacagtagaggcaggcggaattcccggagtagcggtggaatgcgtagagatcgggaagaacatcagtggcgaaggcggcctgctgggctgttgctgacgctgaggcgcgacagcgtggggagcaaacagg

SEQ ID NO: 2092 - DNA, 253 bp, Unknown
  Description of Unknown: bacterium polynucleotide
  Gemm-1
tacagagggtgcgagcgttgtccggaattactgggcgtaaagggcgcgtaggcggcttgataagtaggaggtgaaattccatggctcaaccatggatcggccttctagactgtcaggcttgagcacggtagaggcagatggaattcccggtgtagcggtggaatgcgtagagatcgggaagaacaccagtggcgaaggcggtctgctgggccgttgctgacgctgaggcgcgacagcgtggggagcaaacagg

SEQ ID NO: 2093 - DNA, 252 bp, Unknown
  Description of Unknown: bacterium polynucleotide
  Gemm-1
tacagagggtgcgagcgttgtccggaatcactgggcgtaaaggcgcgtaggtggctgtataagtcgggggtgaaatgctgcggctcaaccgcagcgctgccttcgagactgcacggcttgagcacggtagaggccgatggaattcccggtgtagcggtggaatgcgtagagatcgggaagaacaccgatggcgaaggcagtcggctgggccgttgctgacactgaggcgcgacagcgtggggagcaaacagg

SEQ ID NO: 2094 - DNA, 253 bp, Unknown
  Description of Unknown: bacterium polynucleotide
  Gemm-1
tacgtagggtgcgagcgttgtccggaatcactgggcgtaaagggcgtgtaggcggctggataagccgcgtgtgaaatcccggggctcaaccccggaacggcacgcgggactgttcggctagagaatggtagaggcaagtggaattcctggtgtagcggtggaatgcgtagagatcaggaagaacaccggtggcgaaggcggcttgctgggccatttctgacgctgaggcgcgaaagcgtggggagcaaacagg

SEQ ID NO: 2095 - DNA, 253 bp, Unknown
  Description of Unknown: bacterium polynucleotide
  Gemm-1
tacagagggtgcgagcgttgtccggaatcactgggcgtaaagggcgcgtaggcggcttggtaagtagggggtgaaatcttgcggctcaactgcaaggctgccttctaaactgccgggcttgagcacagtagaggcaggtggaattcccggtgtagcggtggaatgcgtagagatcgggaagaacatcggtggcgaaggcggcctgctgggctgttgctgacgctgaggcgcgacagcgtggggagcaaacagg

SEQ ID NO: 2096 - DNA, 253 bp, Unknown
  Description of Unknown: bacterium polynucleotide
  Gemm-1
tacgtatggtgcgagcgttgtccggaatcactgggcgtaaagggcgcgtaggcggcctgataagtagggggtgaaatcctgcagcttaactgcagggctgcctcctaaactgttgggctagagcacggtagaggcagatggaattcccggtgtagcggtggaatgcgtagagatcgggaagaacatcagtggcgaaggcggtctgctgggccgttgctgacgctgaggcgcgacagcgtggggagcaaacagg

SEQ ID NO: 2097 - DNA, 253 bp, Unknown
  Description of Unknown: bacterium polynucleotide
  Gemm-1
tacagagggtgcgagcgttgtccggaatcactgggcgtaaagggcgcgtaggcggttttgtaagtcgggggtgaaatgctgcggctcaaccgcagcgctgccttcgagactgcaagactggagcacggtagaggcggatggaattcccggagtagcggtggaatgcgtagagatcgggaagaacaccaatggcgaaggcagtccgctgggccgttgctgacgctgaggcgcgacagcgtggggagcaaacagg

SEQ ID NO: 2098 - DNA, 253 bp, Unknown
  Description of Unknown: bacterium polynucleotide
  Gemm-2
gacggagggtgcaagcgttgttcggaattactgggcgtagagcgcgggcaggtggccctttaagtcctttgtgaaattccggagctcaactccggatgtgcataggatactggaaggctagagactggtagaggcgagcggaattcctggtgtagcggtggaatgcgtagatatcaggaagaacaccggtggcgaaggcggctcgctgggccagttctgacactcatccgcgaaagcgtggggagcaaacagg

SEQ ID NO: 2099 - DNA, 254 bp, Unknown
  Description of Unknown: bacterium polynucleotide
  Gemm-3
tacggagggtgcaagcgttgttcggaattattgggcgtaaagcgcgcgcaggcggctttctaagtccacgggtgaaaggccggggctcaaccccgcgcatgcccaggatactggggagctggagacacgtagaggcaagcggaattccgggtgtagcggtggaatgcgtagagatccggaagaacaccggaggcgaaggcggcttgctgggcgtgatctgacgctgaggcgcgaaagcgtggggagcgaacagg

SEQ ID NO: 2100 - DNA, 255 bp, Unknown
  Description of Unknown: bacterium polynucleotide
  Gemm-3
tacagagggtgcgagcgttgttcggaattactgggcgtaaagcgcgcgcaggcggccctttaagtctacccgtgaaatgccggagctcaactccgtgcacgccgggggatactggagggctggagacaggtagaggcaggcggaattccgggtgtagcggtggaatgtgtagagatccggaagaacaccagaggcgaaggcggcctgctgggccttgtctgacgctgaggcgcgaaagcgtggggagcaaacagg

SEQ ID NO: 2101 - DNA, 254 bp, Unknown
  Description of Unknown: bacterium polynucleotide
  Gemm-3
tacagagggtgcgagcgttgttcggaattactgggcgtaaagcgcgcgcaggcggcttcttaagtccgtcggtcaaatgccggggctcaaccccgagcgtgccgaggatactgggaggctggagacatgtagaggcaagcggaattccgggtgtagcggtggaatgcgtagagatccggaagaacaccggtggcgaaggcggcttgctgggcatgatctgacgctgaggcgcgaaagcgtggggagcgaacagg

SEQ ID NO: 2102 - DNA, 254 bp, Unknown
  Description of Unknown: bacterium polynucleotide
  Gemm-3
tacgaagggtgcaagcgttgttcggaattattgggcgtaaagcgcacgtaggcggccttgtaagtctcactgtgaaagtccggggctcaaccccgggatgccaggggatactgcgaggctggagacaagcagaggttggtagaattccgggtgtagcggtggaatgcgtagagatccggaggaataccagaggcgaaggcggccaactgggcttgttctgacgctgaggtgcgaaagcgtggggagcgaacggg

SEQ ID NO: 2103 - DNA, 254 bp, Unknown
  Description of Unknown: bacterium polynucleotide
  Gemm-3
tacgcagggtgcaagcgttgttcggaattattgggcgtaaagcgcacgtaggcggctttttaagtctcactgtgaaagcctgcggctcaaccgcaggaggccaggggatactggagagctggagataggtagaggcgagcggaattccgggtgtagcggtggaatgcgtagagatccggaagaacaccagaggcgaaggcggcccgctggacctcatctgacgctgaggtgcgaaagcgtggggagcaaacagg

SEQ ID NO: 2104 - DNA, 254 bp, Unknown
  Description of Unknown: bacterium polynucleotide
  Gemm-3
tacagagggtgcgagcgttgttcggaattactgggcgtaaagcgcgcgcaggcggctttctaagtccgtcggtgaaagaccggggctcaaccccgtgtcagccatggatactgggaggctggagacaggtagaggcaagcggaattccgggtgtagcggtggaatgcgtagagatccggaagaacaccggaggcgaaggcggcttgctggacctggtctgacgctgaggcgcgaaagcgtggggagcgaacagg

SEQ ID NO: 2105 - DNA, 253 bp, Unknown
  Description of Unknown: bacterium polynucleotide
  Gemm-5
tacggagggcgcaagcgttgttcggaatcactgggcgtaaagcgcgcgcaggcgggcgtgtaagtcggaagtgaaattccggggctcaaccccggagctgctcccgatactgcatgtctagggaccggtagaggtcggtggaattgcaggtgtagcggtggaatgcgtagagatctgcaagaacacccgtggcgaaggcggccgactgggccggatccgacgctgaggcacgaaagcgtggggatcaaacagg

SEQ ID NO: 2106 - DNA, 254 bp, Unknown
  Description of Unknown: bacterium polynucleotide
  Gemm-5
tacagagggtgcaagcgttgttcggaatcactgggcgtaaagcgcgcgcaggtgggtatgcaagtctgcaagtgaaatccagccgctcaacggctgggctgcttcggatactacatgtctagggaccggtagaggctggtagaattgcaggtgtagcggtggaatgcgtagagatctgcaagaatacccgtggcgaaggcggccagctgggccgggtccgacactgaggcgcgaaagcgtggggagcaaacagg

SEQ ID NO: 2107 - DNA, 253 bp, Unknown
  Description of Unknown: bacterium polynucleotide
  Gemm-5
tacggagggtgcaagcgttgttcggatttactgggcgtaaagcgcgcgcaggtgggtggacaagtcggaagtgaaatcccagggctcaaccctggggctgctcccgaaactgttcgtctagggactggtagaggctggtagaattcccggtgtagcggtggaatgcgtagagatcgggaagaatacctgtggcgaaggcggccagctgggccagatccgacactgaggcgcgaaagcgtggggatcaaacagg

SEQ ID NO: 2108 - DNA, 254 bp, Unknown
  Description of Unknown: bacterium polynucleotide
  Gemm-5
tacagagggtgcaagcgttgttcggaattactgggcgtaaagcgcgcgcaggcggatcctgcaagtcggaagtgaaatttcggggctcaactccgaagctgcttctgatactgcggatctggggaccggtagaggctggtggaattgcaggtgtagcggtggaatgcgtagagatctgcaagaacacccgtggcgaaggcggccagctgggccgggtccgacgctgaggcgcgaaagcgtgggtagcaaacagg

SEQ ID NO: 2109 - DNA, 254 bp, Unknown
  Description of Unknown: bacterium polynucleotide
  Gemm-5
tacagagggtgcaagcgttgttcggaattactgggcgtaaagcgcgcgcaggcggatcctgtaagtcggaagtgaaatttcgcggctcaaccgtgaagctgcttctgatactgcggatctggagatcggtagaggtcggtggaattacaggtgtagcggtggaatgcgtagatatctgtaagaacacccgtggcgaaggcggccgactgggccgaatctgacgctgaggcgcgaaagcgtggggagcaaacagg

SEQ ID NO: 2110 - DNA, 253 bp, Unknown
  Description of Unknown: bacterium polynucleotide
  Gemmatimonadetes
tacagagggtgcgagcgttgtccggaatcactgggcgtaaagggcgcgtaggtggcggcccaagtccatggtgaaagctcgatgctcaacatcgagtcggccacggatactgggttgctcgagcactgtaggggcagatggaattccgggtgtagcggtggaatgcgtagagatccggaagaacaccggtggcgaaggcggtctgctgggcagttgctgacactgaggcgcgacagcgtggggagcaaacagg

SEQ ID NO: 2111 - DNA, 253 bp, Unknown
  Description of Unknown: bacterium polynucleotide
  Gemmatimonadetes
tacggggggtgcgagcgttgtccggagtcactgggcgtaaagggcgcgtaggtggtttgataagggtgtggagaaagcccggggctcaaccccgggtctgccgtgccgactgttagactcgagggctgtagaggcagacggaattccgggtgtagcggtggaatgcgtagagatccggaggaagaccggtggcgaaggcggtctgctgggcagtttctgacactgatgcgcgacagcgtggggagcaaacagg

SEQ ID NO: 2112 - DNA, 253 bp, Unknown
  Description of Unknown: bacterium polynucleotide
  Gemmatimonadetes
tacggggggtgcgagcgttgtccggaatcactgggcgtaaagggcgcgtaggtggtttgataagggtgtggtgaaagtccggggctcaaccccggatcggccgtgccgactgtcaaactcgagggctgtagaggcagacggaattccgggtgtagcggtggaatgcgtagagatccggaggaagaccggtggcgaaggcggtctgctgggcagtttccgacactgatgcgcgacagcgtggggagcaaacagg

SEQ ID NO: 2113 - DNA, 253 bp, Unknown
  Description of Unknown: bacterium polynucleotide
  Gemmatimonadetes
tacagagggtgcgagcgttgtccggaatcactgggcgtaaagggcgcgtaggcggctcggtaagcgtgcggtgaaagcccggggctcaaccccgggtcggccgtgcgaactgtcgagctggagcactgtagaggcaggtggaattccgggagtagcggtggaatgcgtagagatccggaagaacatcggtggcgaaggcggcctgctgggcagtgactgacgctgaggcgcgacagcgtggggagcaaacagg

SEQ ID NO: 2114 - DNA, 253 bp, Unknown
  Description of Unknown: bacterium polynucleotide
  Gemmatimonadetes
tacagagggtgcgagcgttgtccggaatcactgggcgtaaagggcgcgtaggcggctcggtcagcgtgcggtgaaagcccggggctcaaccccgggtcggccgtgcgaactgctgggctggagcactgtagaggcaggtggaattccgggagtagcggtggaatgcgtagagatccggaagaacaccggtggcgaaggcggcctgctgggcagtagctgacgctgatgcgcgacagcgtggggagcaaacagg

SEQ ID NO: 2115 - DNA, 253 bp, Unknown
  Description of Unknown: bacterium polynucleotide
  Gemmatimonadetes
tacagagggtgcgagcgttgtccggaatcactgggcgtaaagggcgcgtaggcggcgcggtaagcgtgcggtgaaagcccggggctcaaccccgggtcggccgtgcgaactgccgcgctcgagcactgtagaggcaggcggaattccgggagtagcggtggaatgcgtagagatccggaagaacaccggtggcgaaggcgacctgctgggcagtggctgacgctgaggcgcgacagcgtggggagcaaacagg

SEQ ID NO: 2116 - DNA, 253 bp, Unknown
  Description of Unknown: bacterium polynucleotide
  Gemmatimonadetes
tacggagggtgcgagcgttgtccggaatcactgggcgtaaagggcgcgtaggtggcgcgaggagtctgtggtgaaagcccgaggctcaacttcgggtcggccgcggatactctcgtgctagagggtggtagaggccaatggaattccgggtgtagcgatggaatgcgtagagatccggaagaacaccggtggcgaaggcggttggctgggccacacctgacactgaggcgcgacagcgtggggagcaaacagg

SEQ ID NO: 2117 - DNA, 253 bp, Unknown
  Description of Unknown: bacterium polynucleotide
  Gemmatimonadetes
tacagagggtgcgagcgttgtccggaatcactgggcgtaaagggcgcgtaggcggctcggtaaggttgcggtgaaagcccggggctcaacccagggtcggccgtggcaactgctgggctggagcactgtagaggcaggtggaattccgggtgtagcggtggaatgcgtagagatccggaagaacaccggtggcgaaggcggcctgctgggcagtagctgacgctgaggcgcgacagcgtggggagcaaacagg

SEQ ID NO: 2118 - DNA, 254 bp, Unknown
  Description of Unknown: bacterium polynucleotide
  Gemmatimonadetes
tacagagggtgcgagcgttgtccggaatcactgggcgtaaagggcgcgtaggtggtggcttaagcgtgcggtgaaagctcggggctcaactccgagtcggccgtgcgaactgggctcactggagcatagtagaggcaggtggaattccgggtgtagcggtggaatgcgtagagatccggaagaacaccggtggcgaaggcggcctgctgggctatggctgacactgaggcgcgacagcgtggggagcaaacagg

SEQ ID NO: 2119 - DNA, 253 bp, Unknown
  Description of Unknown: bacterium polynucleotide
  Gemmatimonadetes
tacagagggtgcgagcgttgtccggaatcactgggcgtaaagggtgcgtaggtggcttggtaagcgtgtggtgaaagtccggggctcaaccccggatctgccgtgcgaactgctgagctcgagcaatgtagaggcaggtggaatttcgggagtagcggtggaatgcgtagagatccgaaagaacaccagtggcgaaggcggcctgctgggcattagctgacactgaggcacgacagcgtggggagcaaacagg

SEQ ID NO: 2120 - DNA, 253 bp, Unknown
  Description of Unknown: bacterium polynucleotide
  Gemmatimonadetes
tacggagggtgcgagcgttgtccggaatcactgggcgtaaagggcgcgtaggtggcggctcaagtcaacggtgaaagctcgacgcttaacgtcgagtcggccgtcgatactgggttgctcgagcgctgtagaggcagatggaattccgggtgtagcggtggaatgcgtagagatcgggaagaacatcagtggcgaaggcggcctgctgggctgttgctgacgctgaggcgcgacagcgtggggagcaaacagg

SEQ ID NO: 2121 - DNA, 253 bp, Unknown
  Description of Unknown: bacterium polynucleotide
  Gemmatimonadetes
tacggggggtgcaagcgttgtccggaatcactgggcgtaaagggcgcgtaggtggtctgataagggtgtggtgaaagcccggggctcaaccccgggtcggccgtgccgactgttagactagagtgctgtaggggcaggcggaattccgggtgtagcggtggaatgcgtagagatccggaggaagaccggtggcgaaggcggcctgctgggcagttactgacactgaggcgcgacagcgtggggagcaaacagg

SEQ ID NO: 2122 - DNA, 253 bp, Unknown
  Description of Unknown: bacterium polynucleotide
  Gemmatimonadetes
tacagagggtgcgagcgttgtccggaatcactgggcgtaaagggcgcgtaggcggcctggtaagcgtgcggtgaaagcccggggctcaaccccgggtcggccgtgcgaactgcgaggctggagcactgtagaggcaggtggaattccgggtgtagcggtggaatgcgtagagatccggaagaacaccggtggcgaaggcggcctgctgggcagtggctgacgctggggcgcgacagcgtggggagcaaacagg

SEQ ID NO: 2123 - DNA, 254 bp, Unknown
  Description of Unknown: bacterium polynucleotide
  Gemmatimonadetes
tacggggggtgcgagcgttgtccggaatcactgggcgtaaggggcgcgtaggtggcttggcaagcgcgtggtgaaagcccggggctcaaccccgggtctgccatgtgaactgctatggcttgagcactgtagaggcaggtagaattccgggtgtagcggtggaatgcgtagagatccggaagaataccggtggcgaaggcggcctgctgggcagtggctgacactgaggcgcgacagcgtggggagcaaacagg

SEQ ID NO: 2124 - DNA, 253 bp, Unknown
  Description of Unknown: bacterium polynucleotide
  Gemmatimonadetes
tacggagggtgcgagcgttgtccggaatcactgggcgtaaagggcgcgtaggcggccctggcagtcaatggtgaaagcccagggctcaactctgggtcggccactgatactccagggctcgagtttggtagaggcagatggaattccgggtgtagcggtggaatgcgtagagatccggaagaacaccggtggcgaaggcggtctgctgggccaagactgacgctgaggcgcgacagcgtggggagcaaacagg

SEQ ID NO: 2125 - DNA, 253 bp, Unknown
  Description of Unknown: bacterium polynucleotide
  Gemmatimonadetes
tacggagggtgcgagcgttgtccggaatcactgggcgtaaagggcgcgtaggtggcgcgagcagtcaacggtgaaagcccggggctcaaccccgggtcggccgtcgatactctcgtgcttgagcactgtagaggcaggtggaattccgggtgtagcggtggaatgcgtagagatccggaagaacaccggtggcgaaggcggcctgctgggcagtagctgacactgaggcgcgacagcgtggggagcaaacagg

SEQ ID NO: 2126 - DNA, 253 bp, Unknown
  Description of Unknown: bacterium polynucleotide
  Gemmatimonadetes
tacagagggtgcgagcgttgtccggaatcactgggcgtaaagggcgcgtaggcggtggccgaagcgtgcggtgaaagcccggggctcaaccccgggtcggccgtgcgaactgggtcactcgagtactgtagaggcgagtggaattccgggagtagcggtggaatgcgtagagatccggaagaacaccggtggcgaaggaggctcgctgggcagtgactgacgctgaggcgcgacagcgtggggagcaaacagg

SEQ ID NO: 2127 - DNA, 253 bp, Unknown
  Description of Unknown: bacterium polynucleotide
  Gemmatimonadetes
tacagggggtgcgagcgttgtccggaatcactgggcgtaaagggcgcgtaggcggtccgttaagcgtgtggtgaaagcccggggctcaactccgggtcggccatgcgaactgggggactggagcttgtcagaggcaggcggaattccgggagtagcggtggaatgcgtagagatccggaagaacaccggtggcgaaggcggcctgctgggacagtgctgacgctgaggcgcgacagcgtggggagcaaacagg

SEQ ID NO: 2128 - DNA, 253 bp, Unknown
  Description of Unknown: bacterium polynucleotide
  Gemmatimonadetes
tacagagggtgcgagcgttgtccggaatcactgggcgtaaagggcgcgcaggtggcccggcaagtcagtggtgaaagctcgatgctcaacatcgagtcggccactgatactgcggggctggagcactgtagaggcagatggaattccgggtgtagcggtggaatgcgtagagatccggaagaacaccggtggcgaaggcggtctgctgggcagtagctgacactgaggcgcgacagcgtggggagcaaacagg

SEQ ID NO: 2129 - DNA, 253 bp, Unknown
  Description of Unknown: bacterium polynucleotide
  Gemmatimonadetes
tacggagggtgcgagcgttgtccggaatcactgggcgtaaagggcgcgtaggcggcttggtaagggggcggtgaaagcccggggctcaaccccgggtctgccggaccgactgccgagcttgagcacactaggggcgggtggaattccgggagtagcggtggaatgcgtagagatccggaagaacaccggtggcgaaggcggcccgccggggtgtagctgacgctgaggcgcgacagcgtggggagcaaacagg

SEQ ID NO: 2130 - DNA, 253 bp, Unknown
  Description of Unknown: bacterium polynucleotide
  Gemmatimonadetes
tacggggggtgcgagcgttgtccggaatcactgggcgtaaagggcgcgtaggtggtctgataagggtgtggtgaaagtccggagctcaactccggatctgccgtgccgactgtcagactcgagggctgtagaggcagacggaattccgggtgtagcggtggaatgcgtagagatccggaggaagaccggtggcgaaggcggtctgctgggcagtttctggcactgaggcgcgacagcgtggggagcaaacagg

SEQ ID NO: 2131 - DNA, 253 bp, Unknown
  Description of Unknown: bacterium polynucleotide
  Gemmatimonadetes
tgcggagggtgcgagcgttgtccggaatcactgggcgtaaagggcgcgtaggtggcctcttaagtgtgtggtgaaagcccggggctcaaccccgggtcggccatgcaaactggggggctggagcattgtagaggcaggcggaattccgggagtagcggtggaatgcgtagagatccggaagaacaccggtggcgaaggcggcctgctgggcaattgctgacactgaggcgcgacagcgtggggagcaaacagg

SEQ ID NO: 2132 - DNA, 253 bp, Unknown
  Description of Unknown: bacterium polynucleotide
  Gemmatimonadetes
tacggagggtgcgagcgttgtccggaatcattgggcgtaaagggcgcgtaggtggcgggacaagcgtgcggtgaaagctcggggctcaaccccgcgtcggccgtgcgaactgttttgcttgagcactgtaggggcaggcggaattccgggtgtagcggtggaatgcgtagagatccggaagaacaccggtggcgaaggcggcctgctgggcagtagctgacgctgatgcgcgacagcgtggggagcaaacagg

SEQ ID NO: 2133 - DNA, 254 bp, Unknown
  Description of Unknown: bacterium polynucleotide
  Gemmatimonadetes
tacggagggtgcgtgcgttgtccggaatcactgggcgtaaagggcgcgtaggtggcctgtggaagtctgcggtgaaagcccggcgctcaacgccgggtctgccgtggatactctcgggcttgagcttactagaggcagatggaattccgggtgtagcggtggaatgcgtagagatccggaagaacaccggtggcgaaggcggtctgctggggtaatgctgacactgaggcgcgacagcgtggggagcaaacagg

SEQ ID NO: 2134 - DNA, 253 bp, Unknown
  Description of Unknown: bacterium polynucleotide
  Gemmatimonadetes
tacagagggtgcgagcgttgtccggaatcactgggcgtaaagggcgcgtaggtggcttggtaagcgtgtggtgaaagtccggggctcaaccccggatctgccgtgcgaactgccgagcttgagcgatgtagaggcaggtggaatttcgggtgtagcggtggaatgcgtagatatccgaaagaacaccagtggcgaaggcggcctgctgggcatcagctgacactgaggcgcgacagcgtggggagcaaacagg

SEQ ID NO: 2135 - DNA, 253 bp, Unknown
  Description of Unknown: bacterium polynucleotide
  Gemmatimonadetes
tacggagggtgcgagcgttgtccggaatcactgggcgtaaagggcgcgtaggcggcctcttaagcgggcggtgaaagcccggggctcaaccccgggtcggccgtgcgaactgggaggctcgagcactgtagaggcaggtggaattccgggagtagcggtggaatgcgtagagatccggaagaacaccggtggcgaaggcggcctgctgggcagtggctgacgctgaggcgcgacagcgtggggagcaaacagg

SEQ ID NO: 2136 - DNA, 255 bp, Unknown
  Description of Unknown: bacterium polynucleotide
  Gemmatimonadetes
tacgaagggggctagcgttgctcggaatcactgggcgtaaagggcgcgtaggcggccccgtaacgcgtgccgtgaaagcccggggctcaaccccgggtcggcggtgcgaacgggggggctggagcatgcgagaggcgggcggtattccgggtgtagcggtggaatgcgtagagatccggaagaacaccgggggcgaaggcggcccgctggcgcatatgctgacgctgaggcgcgacagcgtggggagcaaacagg

SEQ ID NO: 2137 - DNA, 253 bp, Unknown
  Description of Unknown: bacterium polynucleotide
  Gemmatimonadetes
tacggagggtgcgagcgttgtccggaatcactgggcgtaaagggcgcgtaggcggcgcggatagtcggcggtgaaagcccggagctcaactccgggtcggccgtcgatacttccgggcttgagcactgtagaggcagatggaattccgggggtagcggtggaatgcgtagagatccggaagaacaccggtggcgaaggcggtctgctgggcagttgctgacgctgatgcgcgacagcgtggggagcaaacagg

SEQ ID NO: 2138 - DNA, 254 bp, Unknown
  Description of Unknown: bacterium polynucleotide
  Gemmatimonadetes
tacggagggtgcgagcgttgtccggaatcactgggcgtaaagggcgcgtaggcggcccgcgcaagcgtgcggtgaaagcccggggctcaaccccgggtcggccgtgcggactgcggggctcgagcactgtaggggcagatggaattccgggtgtagcggtggaatgcgtagagatccggaagaacaccggtggcgaaggcggtctgctgggcagtagctgacgctgaggcgcgacagcgtggggagcaaacagg

SEQ ID NO: 2139 - DNA, 253 bp, Unknown
  Description of Unknown: bacterium polynucleotide
  Gemmatimonadetes
tacggggggtgcaagcgttgtccggaatcactgggcgtaaagggcgcgtaggtggtttgataagggtgtggtgaaagcccggagctcaactccgggtctgccgtgccgactgccaaactcgaggactgtagaggcaggcggaattccgggagtagcggtggaatgcgtagagatccggaggaagaccggtggcgaaggcggtctgctgggcagtttctgacactgaggcgcgacagcgtggggagcaaacagg

SEQ ID NO: 2140 - DNA, 254 bp, Unknown
  Description of Unknown: bacterium polynucleotide
  Gemmatimonadetes
tacagagggggcaagcgttgttcggaatcactgggcgtaaagggcgcgtaggcggcgcgaggagtcgggggtgaaagtccggggctcaaccccggatcggccttcgagactctcgcgctcgagcacagtagaggcgggcgggatttccgggtgtagcggtggaatgcgtagagatccggaagaacaccggtggcgaaggcggcccgctgggctgtggctgacgctgaggcgcgacagcgtggggagcaaacagg

SEQ ID NO: 2141 - DNA, 253 bp, Unknown
  Description of Unknown: bacterium polynucleotide
  Gemmatimonadetes
tacggggggtgcgagcgttgtccggaatcactgggcgtaaagggcgcgtaggtggctttgtaagtttgcggtgaaagcccggggctcaaccccgggtctgccgtggatactgcaaggcttgagtagtgtagaggcaggtagaatatcgggtgtagcggtggaatgcgtagagatccgatagaagaccggtggcgaaggcggcctgctgggcactaactgacactgaggcgcgacagcgtggggagcaaacagg

SEQ ID NO: 2142 - DNA, 253 bp, Unknown
  Description of Unknown: bacterium polynucleotide
  Gemmatimonadetes
tacggagggtgcgagcgttgtccggaatcactgggcgtaaagggcgcgtaggtggcgcgggcagtcaacggtgaaagttcggggctcaaccctgaatcggccgtcgatactcccgtgcttgagcactgtagaggcagatggaattccgggtgtagcggtggaatgcgtagagatccggaagaacaccggtggcgaaggcggtctgctgggcagtagctgacactgaggcgcgacagcgtggggagcaaacagg

SEQ ID NO: 2143 - DNA, 253 bp, Unknown
  Description of Unknown: bacterium polynucleotide
  Gemmatimonadetes
tacagagggtgcgagcgttgtccggaatcactgggcgtaaagggcgcgtaggcggcgcggtaagcgtgcggtgaaagctcggggctcaactccgagtcggccgtgcgaactgccgggctggagcacactagaggcggatggaattccgggtgtagcggtggaatgcgtagagatccggaagaacaccggtggcgaaggcggtccgctggggtgttgctgacgctgaggcgcgacagcgtggggagcaaacagg

SEQ ID NO: 2144 - DNA, 253 bp, Unknown
  Description of Unknown: bacterium polynucleotide
  Gemmatimonadetes
tacggagggtgcgagcgttgtccggaatcactgggcgtaaagggcgcgtaggcggcttcttaagcgtgtggtgaaagctcggggctcaaccccgagtcggccatgcgaactggggagctcgagcactgcagaggcaggcggaattccgggagtagcggtggaatgcgtagagatccggaagaacaccggtggcgaaggcggcctgctgggacgtggctgacgctgaggcgcgacagcgtggggagcaaacagg

SEQ ID NO: 2145 - DNA, 253 bp, Unknown
  Description of Unknown: bacterium polynucleotide
  Gemmatimonadetes
tacggagggtgcgagcgttgtccggaatcactgggcgtaaagggcgcgtaggcggcttgggaagtccgtggtgaaagcccggggctcaacttcgggtcggccatggatactcctaagctcgagtcgactagaggctaatggaattccgggtgtagcggtggaatgcgtagagatccggaagaacaccggtggcgaaggcggttagctggggtcggactgacgctgaggcgcgacagcgtggggagcaaacagg

SEQ ID NO: 2146 - DNA, 253 bp, Unknown
  Description of Unknown: bacterium polynucleotide
  Gemmatimonadetes
tacggagggtgcgagcgttgtccggaatcactgggcgtaaagggcgcgtaggcggctcatgaaggctgtggtgaaagtccggggctcaacctcggatcggccgtggcgactcgtgggctggagcactgtagaggcgggtggaattccgggagtagcggtggaatgcgtagagatccggaagaacaccagtggcgaaggcggcccgctgggcagtggctgacgctgaagcgcgacagcgtggggagcaaacagg

SEQ ID NO: 2147 - DNA, 253 bp, Unknown
  Description of Unknown: bacterium polynucleotide
  Gemmatimonadetes
tacagagggtgcgagcgttgtccggaatcactgggcgtaaagggcgcgtaggtggcgcgacaagtcagtggtgaaagctcgacgcttaacgtcgagtcggccactgatactgtcgggctggagcactgtagaggctcatggaattccgggtgtagcggtggaatgcgtagaaatccggaagaacaccggtggcgaaggcggtgagctgggcagttgctgacactgaggcgcgacagcgtggggagcaaacagg

SEQ ID NO: 2148 - DNA, 254 bp, Unknown
  Description of Unknown: bacterium polynucleotide
  Gemmatimonadetes
tacggagggtgcgagcgttgtccggaatcactgggcgtaaagggcgcgtaggcggccccttaagggggcggtgaaagcccggggctcaaccccgggtcggccgtgccgactgaggggctggagcactgtagaggcggggaggaattccgggtgtagcggtggaatgcgtagagatccggaagaacaccggtggcgaaggcggcccgctgggcagtggctgacgctgaggcgcgacagcgtggggagcaaacagg

SEQ ID NO: 2149 - DNA, 253 bp, Unknown
  Description of Unknown: bacterium polynucleotide
  Gemmatimonadetes
tacagagggtgcgagcgttgtccggaattactgggcgtaaagggcgcgtaggcggtccgtcacgcgtgccgtgaaagcccggggctcaaccccgggtcggcggtgcgaacggggggactggagcacaccagaggcaggcggaattccgggagtagcggtggaatgcgtagagatccggaagaacaccggtggcgaaggcggcctgctggggtgtggctgacgctgaggcgcgacagcgtggggagcaaacagg

SEQ ID NO: 2150 - DNA, 253 bp, Unknown
  Description of Unknown: bacterium polynucleotide
  Gemmatimonadetes
tacagagggtgcgagcgttgtccggaatcactgggcgtaaagggcgcgtaggtggcgcgacaagtcagtggtgaaagctcggcgctcaacgccgagtcggccactgatactgttgggcttgagcactgtagaggctaatggaattccgggtgtagcggtggaatgcgtagagatccggaagaacaccggtggcgaaggcggttagctgggcagttgctgacactgaggcgcgacagcgtggggagcaaacagg

SEQ ID NO: 2151 - DNA, 253 bp, Unknown
  Description of Unknown: bacterium polynucleotide
  Gemmatimonadetes
tacggagggtgcgagcgttgtccggaatcactgggcgtaaagggcgcgtaggcggcagggaaagtcggcggtgaaagcccggagctcaactccgggtcggccgttgatacttctttgcttgagcactgtagaggcagatggaattccgggtgtagcggtggaatgcgtagagatccggaagaacaccggaggcgaaggcggcttgctgggcatggtctgacgctgaggcgcgaaagcgtggggagcgaacagg

SEQ ID NO: 2152 - DNA, 254 bp, Unknown
  Description of Unknown: bacterium polynucleotide
  Gemmatimonadetes
tacggagggtgcgagcgttgtccggaatcactgggcgtaaagggcgcgtaggcggtggcctaagcgcgcggtgaaagcctggggctcaaccccgggtcggccgtgcggactggggggctcgagcaccgtaggggcaggcggaattccgggtgtagcggtggaatgcgtagagatccggaagaacaccggtggcgaaggcggcctgctgggcggtatgctgacgctgaggcgcgacagcgtggggagcaaacagg

SEQ ID NO: 2153 - DNA, 256 bp, Unknown
  Description of Unknown: bacterium polynucleotide
  Gemmatimonadetes; Ellin5301
tacggagggtgcgagcgttgtccggaatcattgggcgtaaagggcgcgtaggtggcccggtcagtccgtggtgagggcgcggggcccaaccctgcgtcggccatggatactgccgcggctcgagcactgtagaggcaggcggaattccgggtgtagcggtggaatgcgtagaaatccggaagaacaccggtggcgaaggcggcctgctgggcagtttggctgacactgaggcgcgacagcgtggggagcaaacagg

SEQ ID NO: 2154 - DNA, 254 bp, Unknown
  Description of Unknown: bacterium polynucleotide
  Gemmatimonadetes; Ellin5301
tacggagggtgcgagcgttgtccggaatcattgggcgtaaagggcgcgtaggtggcccggtcagttcgtggtgaaagcgcggggctcaaccctgcgtcggccatgaatactgccgcggctggagcactgtagaggcaggcggaattccgggtgtagcggtggaatgcgtagagatccggaagaacaccggtggcgaaggcggcctgctgggcagttgctgacactgaggcgcgacagcgtggggagcaaacagg

SEQ ID NO: 2155 - DNA, 256 bp, Unknown
  Description of Unknown: bacterium polynucleotide
  Gemmatimonadetes; Ellin5301
tacggagggtgcgagcgttgtccggaatcattgggcgtaaagggcgcgtaggtggcccggtcagtctttggtgaaagcgcggggctcaaccctgcgtcggccagggatactgccgcggctcgagcactgtagaggcaggcggaattccgggtgtagcggtggaatgcgtagagatccggaagaacaccggtggcgaaggcggcctgctgggcagtttagctgacactgaggcacgacagcgtggggagcaaacagg

SEQ ID NO: 2156 - DNA, 253 bp, Unknown
  Description of Unknown: bacterium polynucleotide
  Gemmatimonadetes; Ellin5301
tacggagggtgcgagcgttgtccggaatcattgggcgtaaagggcgcgtaggtggcacgatcagcgtgcggtgaaagctcggggctcaaccccgggtcggccgtgcgagctatcgagctggagcactgtagaggcaggcggaattccgggagtagcggtggaatgcgtagagatccggaagaacaccggtggcgaaggcggcctgctgggcagttgctgacactgaggcgcgacagcgtggggagcaaacagg

SEQ ID NO: 2157 - DNA, 253 bp, Gemmatimonas sp.
  Gemmatimonadetes; Gemmatimonadaceae; Gemmatimonas
tacggagggtgcgagcgttgtccggaatcactgggcgtaaagggcgcgtaggcggtctgctaagcgtgcggtgaaagcctggggctcaaccccaggtctgccgtgcgaactggtggactcgagcactgtagaggcaggtggaattccgggtgtagcggtggaatgcgtagagatccggaagaacaccggtggcgaaggcggcctgctgggcagtagctgacgctgaggcgcgacagcgtggggagcaaacagg

SEQ ID NO: 2158 - DNA, 254 bp, Halococcus sp.
  Halobacteria; Halobacteriaceae; Halococcus
taccggcagcccgagtgatagccactcttattgggcctaaagcgtccgtagctggccgaacgggtccgtcgggaaatccacccgctcaacgggtgggcgtccggcggaaaccagtcggcttgggaccggaggacctgcggggtacgtccggggtaggagtgaaatcccgtaatcccggacggaccgccggtggcgaaggcgccgcaggaggacggatccgacagtgagggacgaaagcttgggtctcgaaccgg

SEQ ID NO: 2159 - DNA, 253 bp, Unknown
  Description of Unknown: bacterium polynucleotide
  iii1-8
tacagagggggcaagcgttattcggaattattgggcgtaaagggcgcgtaggcggcttggcaagtggatggtgaaatccctcggcttaaccgaggaactgccgtccaaactgcttcgcttgagaccgggagaggtgagtggaattcccagtgtagcggtgaaatgcgtagatattggggggaacaccagtggcgaaggcggctcactggaccggtactgacgctgatgcgcgaaagcgtggggagcaaacggg

SEQ ID NO: 2160 - DNA, 253 bp, Unknown
  Description of Unknown: bacterium polynucleotide
  iii1-8
tacagagggggcaagcgttattcggaattattgggcgtaaagggcgcgtaggcggcttggcaagtggaaggtgaaatccctcggcttaaccgaggaactgccctccaaactgctttgcttgaggccgggagaggcgagtggaattcccagtgtagcggtgaaatgcgtagatattgggagggacaccagtggcgaaggcggctcgctggaccggttctgacgctgaggcgcgaaagcgtggggagcaaacggg

SEQ ID NO: 2161 - DNA, 253 bp, Unknown
  Description of Unknown: bacterium polynucleotide
  iii1-8
tacagggggggcaagcgttattcggaattattgggcgtaaagggcgcgtaggcggctttgcaagcgacgggtgaaatccctcggcttaaccgaggaactgcctgtcgaactgctttgcttgaggccgggagaggtgagtggaattcccagtgtagcggtgaaatgcgtagatattgggaggaacaccagtggcgaaggcggctcactggaccggttctgacgctgaggcgcgaaagcgtgggcagcaaacagg

SEQ ID NO: 2162 - DNA, 253 bp, Unknown
  Description of Unknown: bacterium polynucleotide
  iii1-8
tacagagggggcaagcgttattcggaattattgggcgtaaagggcgcgtaggcggcctggcaagtggaaggtgaaatccctcggctcaaccgaggaactgccctccaaactgcctggcttgagtccgggagaggtgagtggaattcccagtgtagcggtgaaatgcgtagatattgggaggaacaccagtggcgaaggcggctcactggaccggaactgacgctgaggcgcgaaagcgtggggagcaaacggg

SEQ ID NO: 2163 - DNA, 253 bp, Unknown
  Description of Unknown: bacterium polynucleotide
  koll11
gacagaggtggcaagcgttgttcggatttattgggtgtaaagggcaggtaggtggttatataagtctggtgtgaaatcccacggctcaaccgtggaactgcattggaaactatatgacttgagtatcggagaggtgaggggaattctcggtgtaagggtgaaacctgtagatatcgagaggaacaccagtggcgaaggcgcctcactggccgattactgacactgagctgcgaaagcaaggggagcaaacagg

SEQ ID NO: 2164 - DNA, 253 bp, Unknown
  Description of Unknown: bacterium polynucleotide
  Ktedonobacteria
tacgtaggtggcaagcgttatccggaattattgggcgtaaagcgcgcgtaggcggccgcccgcatccgcagtgaaagcccgcggctcaactgcgggaggtctggggagatggggcggctggaggctggcagaggcagacggaagtcccgcaggagcggtgaaatgcgtagagagcgggaggaacaccggtggcgtaggcggtctgctgggccaggcctgacgctgaggcgcgaaagctaggggagcgaacgga

SEQ ID NO: 2165 - DNA, 253 bp, Unknown
  Description of Unknown: bacterium polynucleotide
  Ktedonobacteria
tacgtacgaggcgagcgttatccggaattattgggcgtaaagcgcgcgcaggcggattggtaagtagggcgtgaaatctcccggcctaactgggaggggtcgccctaaactggcagtcttgaggacagcagaggtaggtggaattcctggtgtagtggtgaaatgcgtagagatcaggaggaacaccggtggcgaaggcggcctactgggctgtctctgacgctgaggcgcgaaagctcggggagcgaacggg

SEQ ID NO: 2166 - DNA, 253 bp, Unknown
  Description of Unknown: bacterium polynucleotide
  Ktedonobacteria
tacgtacgaggcaagcgttatccggaattattgggcgtaaagcgcgcgcaggcgggctgttaagtagggcgtgaaatctcccggcctaactgggaggggtcgctctaaactggcagtcttgaggacagcagaggtaggtggaattcctggtgtagtggtgaaatgcgtagagatcaggaggaacaccggtggcgaaggcggcctactgggctgtcactgacgctgaggcgcgaaagcgtggggagcgaaccgg

SEQ ID NO: 2167 - DNA, 253 bp, Unknown
  Description of Unknown: bacterium polynucleotide
  Ktedonobacteria; Ktedonobacteraceae
tacgtaggaggcgagcgtcgtccggagttactgggcgtaaagcgcacgcaggcggtcttttaagtctgtagggacagggcacagctcaactgtgtcaggcttacggaaactgggagacttgagggcttcagagggatggggaattccgggtggagtggtgaaatgcgtagagatccggaagaacaccaaaggcgaaggcaccatcctggggagtcactgacgctcgggtgcgaaagccaggggagcgaacggg

SEQ ID NO: 2168 - DNA, 253 bp, Unknown
  Description of Unknown: bacterium polynucleotide
  Ktedonobacteria; Ktedonobacteraceae
tacgtagggggcaagcgttgtccggagttactgggcgtaaagcgcacgcaggcggtctggtaagtttggagtgacagtcatcggcttaactgatgaagtgcttcgaaaactgcccgacttgagggcttcagagggacacggaattccgggtgtagtggtgaaatgcgtagatatccggaggaacaccaaaggcgtaggcagtgtcctgggaagttcctgacgctcaggtgcgaaagctaggggagcgaacggg

SEQ ID NO: 2169 - DNA, 253 bp, Unknown
  Description of Unknown: bacterium polynucleotide
  Ktedonobacteria; Ktedonobacteraceae
tacgtaggaggcgagcgttgtccggagttactgggcgtaaagcgcacgcaggcggtcagatcagtctggagtgacagtcgtcggcttaaccgacgaagtgttctggaaactgtctgacttgagggcttcagagggacacggaattccgggtggagtggtgaaatgcgtagagatcggaaagaacaccaacggcgaaagcactctgctgggccgacactgacactgagagacgaaagctaggggagcgaatggg

SEQ ID NO: 2170 - DNA, 253 bp, Unknown
  Description of Unknown: bacterium polynucleotide
  Ktedonobacteria; Ktedonobacteraceae
tacgtaggaggcgagcgttgtccggagttactgggcgtaaagcgcatgcaggcggtccaatcagtctgcagggacagggcacagcttaactgtgtcaggcctgtggaaactgttggacttgagggcttcagagggatggggaattccgggtggagtggtgaaatgcgtagagatccggaagaacaccaaaggcgaaggcaccatcctggggagtcactgacgctcggatgcgaaagctaggggagcgaacggg

SEQ ID NO: 2171 - DNA, 253 bp, Unknown
  Description of Unknown: bacterium polynucleotide
  Ktedonobacteria; Ktedonobacteraceae
tacgtaggaggcaagcgttgtccggagttattgggcgtaaagcgcacgcaggcggtcctgtcagtctggggtgacagttcccggcttcaccgggaaagtgctctggaaactgcaggacttgagggcttcagagggatgtggaattccaggtggagtggtgaaatgcgtagggatctggaagaacaccaaaggcgaaggcagcatcctgggaagttcctgacgctcgggtgcgaaagccaggggagcgaacggg

SEQ ID NO: 2172 - DNA, 253 bp, Unknown
  Description of Unknown: bacterium polynucleotide
  Ktedonobacteria; Ktedonobacteraceae
tacgtagggggcgagcgttgtccggagttactgggcgtaaagcgcacgcaggcggtttcgtacgtctggagtgacagttcccggctcaactgggaaaggtcttcggaaacggcgagacttgagggcttcagagggacacggaattccgggaggagtggtgaaatgcgtagagatccggaggaacaccaatggcgaaggcagtgtcctgggaagcatctgacgctcaggtgcgaaagctaggggagcgaacagg

SEQ ID NO: 2173 - DNA, 253 bp, Unknown
  Description of Unknown: bacterium polynucleotide
  Ktedonobacteria; Ktedonobacteraceae
tacgtagggggcaagcgttatccggaattattgggcgtaaagcgcacgcaggcggtctgccaagtttggagtgacagttggtggctcaaccatcaaagtgctttgaaaactggcagacttgaggacttcagagggacacggaattccgggtggagtggtgaaatgcgtagatatctggaagaacaccaatggcgaaggcaatgttctggctcgtttctgacgctcaggtgcgaaagccaggggagcgaacggg

SEQ ID NO: 2174 - DNA, 253 bp, Unknown
  Description of Unknown: bacterium polynucleotide
  Ktedonobacteria; Ktedonobacteraceae
tacgtagggggcgagcgttgtccggagttactgggcgtaaagcgcacgcaggcggtctgctaagtttggagtgacagttgatggctcaaccatcaaagtgctttgaaaactgacagacttgagggcttcagagggacacggaattccgggtggagtggtgaaatgcgtagagatccggaggaacaccagtggcgaaggcggctgcctgggcctggcctgacgctgaggcgcgaaagcgtggggagcgatccgg

SEQ ID NO: 2175 - DNA, 253 bp, Unknown
  Description of Unknown: bacterium polynucleotide
  Ktedonobacteria; Ktedonobacteraceae; FFCH10602
tacgtagggggcgagcgttgtccggatttactgggcgtaaagggcacgcaggcggtcctgtcagtttctagtgacaggtcagagcttaactctgacaggcctagaaagacggcaggacttgagtacttcagagggacgcggaattccaggtggagcggtgaaatgcgtagagatctggaagaacaccaaaggcgaaggcagcgtcctgggaagttactgacgctcaggtgcgaaagctaggggagcgaacggg

SEQ ID NO: 2176 - DNA, 253 bp, Unknown
  Description of Unknown: bacterium polynucleotide
  Ktedonobacteria; Thermogemmatisporaceae
tacgtagggggcgagcgttgtccggagttactgggcgtaaagggcgtgcaggcggtgcggtaagtttagagtgacagtatccggcttaactggataaggcctctgaaaactgccggacttgagggccagagagggacatagaattccgggtggagtggtgaaatgcgtagatatccggaggaataccaaaggcgaaggcagtgtcctggctggcaactgacgctgaggcgcgaaagctaggggagcgaacagg

SEQ ID NO: 2177 - DNA, 253 bp, Unknown
  Description of Unknown: bacterium polynucleotide
  Ktedonobacteria; Thermogemmatisporaceae
tacgtagggggcgagcgttgtccggatttattgggcgtaaagcgcacgcaggcggtttcgtaagtttggagtgacagtacccggctcaaccgggtgaggccttcgaaaactgcgggacttgaggaccagagagggacatagaattccgggaggagtggtgaaatgcgtagatatccggaggaataccaaaggcgaaggcagtgtcctggctggtaactgacgctcaggtgcgaaagctaggggagcgaacagg

SEQ ID NO: 2178 - DNA, 253 bp, Unknown
  Description of Unknown: bacterium polynucleotide
  Ktedonobacteria; Thermogemmatisporaceae
tacgtagggggcgagcgttgtccggagttactgggcgtaaagggcatgcaggcggtcagacgcgttttgtgtgacagcgggtggcttaactacccgagcatgcgaaagacggtgtgacttgagggctcgagagggacacggaattccgggtggagtggtgaaatgcgtagagatccggaggaacaccgaaggcgaaggcagtgtcctggcgagtgactgacgccgaggtgcgaaagccaggggagcgaaccgg

SEQ ID NO: 2179 - DNA, 253 bp, Unknown
  Description of Unknown: bacterium polynucleotide
  Ktedonobacteria; Thermogemmatisporaceae
tacatagggggcaagcgttgtccggagttactgggcgtaaagcgcacgcaggcggtgcggtaagttccatgtgacagtgcccggcttaactgggcaaggctatggaaaactgccggacttgagggccagagagggacatagaattccgggtggagtggtgaaatgcgtagatatccggaggaataccaaaggcgaaggcagtgtcctggctggcaactgacgctgaggtgcgaaagctaggggagcgaacagg

SEQ ID NO: 2180 - DNA, 252 bp, Unknown
  Description of Unknown: bacterium polynucleotide
  Ktedonobacteria; Thermogemmatisporaceae
tacgtagggggcgagcgttgtccggaattattgggcgtaaagggcacgcaggcggttcgccaagttcgaagtgacaatcaacggcttaaccggtgaacgacttcgaaaactggtggacttgagagcgagagagggacatggaactccgggtggagcagtgaaatgcgtagagatccggaagaacaccaaggcgaaggcagtgtcctggctcgtttctgacgctgaggtgcgaaagccaggggagcgaacggg

SEQ ID NO: 2181 - DNA, 253 bp, Unknown
  Description of Unknown: bacterium polynucleotide
  Ktedonobacteria; Thermogemmatisporaceae
tacgtagggggcgagcgttgtccggatttattgggcgtaaagggcccgcaggcggtccgccaagtttggggtgaaagctcctcgcttaacgaggagagagccgcaaaaactggtggacttgagagcgagagagggacacggaactccgggtggagcagtgaaatgcgtagatatccggaagaacaccaaaggcgaaggcagtgtcctggctcgtatctgacgctcaggggcgaaagccaggggagcgaacggg

SEQ ID NO: 2182 - DNA, 253 bp, Unknown
  Description of Unknown: bacterium polynucleotide
  MB-A2-108
tacgtaggtgacgagcgttgtccggattcattgggcgtaaagagcgcgtaggcggctcggaaagtcggtcgtgaaatcctggggctcaaccccggaactgcgtccgatacttccgagctggaggcaggtaggggagatcggaattcctggtgtagcggtgaaatgcgcagatatcaggaggaacaccggtggcgaaggcggatctctgggccttgcctgacgctgaggcgcgaaagctaggggagcgaacagg

SEQ ID NO: 2183 - DNA, 253 bp, Unknown
  Description of Unknown: bacterium polynucleotide
  MB-A2-108
gacgtagggagcgagcgttgtccggattcattgggcgtaaagcgcgcgtaggcggcctcgcaagtcggttgtgaaatcccggggctcaaccccgggactgcgtccgatactgcgaggctggaggtaggtaggggagatcggaattcctggtgtagcggtgaaatgcgcagatatcaggaggaacaccggtggcgaaggcggatctctgggccttacctgacgctgaggcgcgaaagctaggggagcgaacagg

SEQ ID NO: 2184 - DNA, 254 bp, Methanobrevibacter sp.
  Methanobacteria; Methanobacteriaceae; Methanobrevibacter
caccggcagctctagtggtagctgtttttattgggcctaaagcgttcgtagccggttagataagtcactggtgaaatcctgtagcttaactgtgggaattgctggtgatactgttgaacttgaggtcgggagaggttagcggtactcccagggtagaggtgaaattctgtaatcctgggaggaccacctgtggcgaaggcggctaactggaacgaacctgacggtgagggacgaaagctaggggcgcgaaccgg

SEQ ID NO: 2185 - DNA, 253 bp, Unknown
  Description of Unknown: bacterium polynucleotide
  ML635J-21
tacgtaggatgcaagcgttgtccggaattattgggcgtaaagcgaacgtaggcggttacttaagtctggacttaaagaccggggctcaacctcgggaatggttcggatactgggtgactagaggatgtcagaggaaagtggaattccaagtgtagcggtgaaatgcgtagatatttggaggaacaccagtggcgaaagcggctttctgggacattcctgacgctgaggttcgaaagctcggggagcaaacagg

SEQ ID NO: 2186 - DNA, 253 bp, Unknown
  Description of Unknown: bacterium polynucleotide
  ML635J-21
tacgtaggatgcaagcgttgttcggaattactgggcgtaaggagtacgtaggcggtatggtaagtctgatattaaagaccggggctcaacttcgggagtgtatcggaaactgccaaactagaggacaatagaggaagtcggaattctcagtgtagcggtgaaatgcgtagatattgggaagaacaccagtggcgaaagcggacttctgggttgttactgacgctgaggtacgaaagcgtggggagcaaacggg

SEQ ID NO: 2187 - DNA, 252 bp, Unknown
  Description of Unknown: bacterium polynucleotide
  Mollicutes
tacataggtggcaagcgttatccggatttattgggcgtaaagggtgcgtaggtggtaatataagtccaaggttaaaggtcaaagctcaactttgatgcgccttggaaactgtataactagagtacaggagaggttagtggaattccatgtgtagcggtggaatgcttagatatatggaggaacaccagcggcgaaggcgactaactggcctgtaactgacactgaggcacgaaagcaggaggatcaaatagg

SEQ ID NO: 2188 - DNA, 252 bp, Unknown
  Description of Unknown: bacterium polynucleotide
  Mollicutes
tacataggtggcaagcgttatccggatttattgggcgtaaagcgtgcgtagacggttatgcaagtctgaggttaaatttaggggctcaacccctaaccgccttggaaactacatgactagagtataggagaggttagtggaatttcatgtgtagcggtggaatgcgtagatatatgaaggaacaccagtggcgaaggcggctaactggcctattactgacgttgtggcacgaaagcgtggggagcaaatagg

SEQ ID NO: 2189 - DNA, 252 bp, Unknown
  Description of Unknown: bacterium polynucleotide
  Mollicutes
tacataggtggcaagcgttatccggatttattgggcgtaaagcgtgcgtagacggttctgcaagtctgaggttaaatctaggagctcaactcctatccgcctcggaaactacagtactagagtatagaagaggttagtggaatttcatgtgtagcggtggaatgcgtagatatatgaaggaacaacagtggcgaaggcggctaactggtctaatactgacgttgtggcacgaaagcgtggggagcaaatagg

SEQ ID NO: 2190 - DNA, 252 bp, Unknown
  Description of Unknown: bacterium polynucleotide
  Mollicutes
tacataggtggcaagcgttatccggatttattgggcgtaaagggtgcgtagacggttttgcaagtctgaggttaaatatgagagctcaactctcatccgccttggaaactgtaagactagagtataggagaggctagtggaattccatgtgtagcggtggaatgtgtagatatatggaggaacaccagtggcgaaggcggctagctggcctaatactgacgttgaggcacgaaagcgtggggagcaaatagg

SEQ ID NO: 2191 - DNA, 252 bp, Candidatus phytoplasma
  Mollicutes; Acholeplasmataceae; Candidatus Phytoplasma
tacatagggggcaagcgttatccggaattattgggcgtaaagggtgcgtaggctgttaaataagtttatggtctaagtgcaatgctcaacattgtgatgctataaaaactgtttagctagagtaagatagaggcaagtggaattccatgtgtagtggtaaaatgcgtaaatatatggaggaacaccagtagcgaaggcggcttgctgggtctttactgacgctgaggcacgaaagcgtggggagcaaacagg

SEQ ID NO: 2192 - DNA, 254 bp, Asteroleplasma sp.
  Mollicutes; Anaeroplasmataceae; Asteroleplasma
gacataggtggcaaacgttatccggaattactgggcgtaaagtgtgcgtaggtggttgaataagttactggtggcaaatcggggctcaacttcgtggaagctagtaatactattcaactcgagggccggagaggttaacggaattctatatgtagcggtaaaatgctcaaatatatagaggaacaccaatcggcgaaggcagttaacaattcggttcctgacgttgaggcacgaaagcgtggggagcaagacgg

SEQ ID NO: 2193 - DNA, 256 bp, Asteroleplasma sp.
  Mollicutes; Anaeroplasmataceae; Asteroleplasma
gacgtaggtggcgaacgttatccggaattattgggcgtaaagggtgcgtagatggcctgacaagttaacagtggtaaatcgaggctcaacctcgtggaaactgataatactgtctggctcgagtgcagaagaggttaacggaattccatgtggagcggtaaaatgcgtagatatatggaagaacaccaataacggcgaaggcagttaactattctgttactgacattgaggcacgaaagcgtggggagcaaaacgg

SEQ ID NO: 2194 - DNA, 254 bp, Asteroleplasma sp.
  Mollicutes; Anaeroplasmataceae; Asteroleplasma
gacataggtggcaaacgttatccggaattactgggcgtaaagagtgcgtaggtggttcaataagttactggtggcaaatcggggcccaaccccgtggaagttggtaatactgttgaactagaggaccggagaggttaacggaattctatgtgtagcggtaaaatgctcaaatatatagaggaacaccaaacggcgaaggcagttaactattcggtgcctgacgttgaggcacgaaagcgtggggagcaagacgg

SEQ ID NO: 2195 - DNA, 256 bp, Asteroleplasma sp.
  Mollicutes; Anaeroplasmataceae; Asteroleplasma
gacgtaggtggcgaacgttatccggaatcattgggcgtaaagggtgcgtaggcggcatgataagttattggcgggaaatcgagggtcaacctcgtggaaactgataatactgtcttgcttgagtgcaggagaggttaacggaattctttgtggaggggtaaaatccaaagatataaaggagaacatcaataacggcgaaggcagttaactattctgttactgacgttgaggcacgaaagcgtggggagcaaaacgg

SEQ ID NO: 2196 - DNA, 252 bp, Unknown
  Description of Unknown: bacterium polynucleotide
  Mollicutes; Entomoplasmataceae
tacataggtggcaagcgttatccggatttattgggcgtatagggtgcgtaggcggtcttgcaagtttaaggttaaagcccggagctcaactccggttcgccttaaaaactgcataactagaatacaagagaggtaagtggaattccatgtgtagcggtgaaatgcgtagatatatggaggaacacctttggcgaaagcggcttactggcttgttattgacgctgaggcacgaaagcgtggggagcaaatagg

SEQ ID NO: 2197 - DNA, 252 bp, Mycoplasma sp.
  Mollicutes; Mycoplasmataceae; Mycoplasma
aacataggtcacgagcattatccggatttattgggcgtaaaggaagcgtaggcggggaggttgatccattgttaaaagcatttgcttaacaaatgtgtgcattggagatcgcctccctagagttaatcagggggtactggaattcaatgtgtagcggtggaatgcgtagatatattgaggaacaccagaggctaaggcgagtgcctaggatataactgacgctgaggcttgaaagcgtggggagcaaatggg

SEQ ID NO: 2198 - DNA, 252 bp, Mycoplasma sp.
  Mollicutes; Mycoplasmataceae; Mycoplasma
aacataggtcacgagcattatccggatttattgggcgtaaaggaagcgtaggtgggaaggttgatccattgttaaaggcatttgcttaacaaatgtgtgcgatggagatcgccttcctagagttaatcagggggtactggaattcaatgtgtagcggtggaatgcgtagatatattgaggaacaccagaggctaaggcgagtacctaggatataactgacactgaggcttgaaagcgtggggagcaaatggg

SEQ ID NO: 2199 - DNA, 252 bp, Mycoplasma sp.
  Mollicutes; Mycoplasmataceae; Mycoplasma
tacatagggtgcaagcgttatccggaattattgggcgtaaagcgtccgtaggtggtatgttaagtctgaagtcaaataccggagctcaactccggcccgctttagaaactggcatactagagtcatgcagaggttagtggaatttcatatgtagcggtggaatgcgtagatatgtgaaggaacaccaatggcgaaggcaactaactggacatgcactgacactgagggacgaaagcgtggggagcaaacagg

SEQ ID NO: 2200 - DNA, 253 bp, Unknown
  Description of Unknown: bacterium polynucleotide
  Nitrospira
gacagaggtggcaagcgttgttcggatttattgggcgtaaagagcgcgtaggcggtcttttaagtcgggggtgaaatcccggggcttaaccccggaattgcctccgatactggaagacttgagtgcgggagaggatagtggaattcccagtgtagcggtgaaatgcgtagatatcgggaggaaggccggtggcgaaggcggccatctggcgctgaactgacactgaggcgcgaaagcgtggggagcaaacagg

SEQ ID NO: 2201 - DNA, 253 bp, Unknown
  Description of Unknown: bacterium polynucleotide
  Nitrospira; 0319-6A21
gacagagggggcaagcgttgctcggaatcactgggcgtaaagggcgtgtaggcgggagcgtgagtcggtcgtgaaagccttcggctcaaccgaagaagggcggccgatactgcgttccttgaggggtggagaggagactggaattcctggtgtagcggtgaaatgcgcagatatcaggaggaacaccggtggcgaaggcgggtctctgggccgacactgacgctgaggagcgaaagcgtggggagcgaacagg

SEQ ID NO: 2202 - DNA, 253 bp, Unknown
  Description of Unknown: bacterium polynucleotide
  Nitrospira; Nitrospiraceae
gacgaaggtggcaagcgttgttcagatttactgggcgtaaagggagcgtaggtggttaggtaagccctccgggaaatcttcaggcttaacctgaaaaggtcgggggggactgcctagctagagggcgggagaggagcgcggaattcccggtgtagcggtgaaatgcgtagagatcgggaggaaggccggtggcgaaggcggcgctctggaacgtttctgacactgaggctcgaaagcgtggggagcaaacagg

SEQ ID NO: 2203 - DNA, 253 bp, Unknown
  Description of Unknown: bacterium polynucleotide
  Nitrospira; Nitrospiraceae
tacgaaggtggcaagcgttgttcggatttactgggcgtaaagggagcgtaggcggttaggtaagccctccgggaaatctccaggctcaacctggaaaggtcggtggggactgcctagctcgaggacgggagaggagcgcggaattcccggtgtagcggtgaaatgcgtagagatcgggaggaaggccggtggcgaaggcggcgctctggaacggccctgacgctgaggctcgaaagcgtggggagcaaacagg

SEQ ID NO: 2204 - DNA, 253 bp, Nitrospira sp.
  Nitrospira; Nitrospiraceae; Nitrospira
tacgaaggtggcaagcgttgttcggatttactgggcgtacagggagcgtaggcggttggataagccctccgtgaaatctccaggcttaacctggaaagtgcagaggggactgttcagctagaggatgggagaggagcgcggaattcccggtgtagcggtgaaatgcgtagagatcgggaggaaggccggtggcgaaggcggcgctctggaacatttctgacgctgaggctcgaaagcgtggggagcaaacagg

SEQ ID NO: 2205 - DNA, 253 bp, Unknown
  Description of Unknown: bacterium polynucleotide
  Nostocophycideae; Nostocaceae
tacggaggatgcaagcgttatccggaatgattgggcgtaaagcgtgggtaggtggcatttcgtgtctgctgttaaagcgcgtggctcaaccacgcatcagcggtggaaacagaaaagctagagggcggtcggggcagagggaattcctggtgtagcggtgaaatgcgtagagatcaggaagaacaccggtggcgaaagcgctctgctaggtcgcacctgacactgatccacgaaagctaggggagcgaatggg

SEQ ID NO: 2206 - DNA, 253 bp, Unknown
  Description of Unknown: bacterium polynucleotide
  Nostocophycideae; Nostocaceae
tacggaggatgcaagcgttatccggaatgattgggcgtaaagcgtccgcaggtggctgtgtaagtctgctgttaaatagtggggctcaacctcataaaggcagtggaaactacatggctagagtgcgttcggggcagagggaattcctggtgtagcggtgaaatgcgtagagatcaggaagaacgccggtggcgaaagcgctctgctaggccgcaactgacactgagggacgaaagctaggggagcgaatggg

SEQ ID NO: 2207 - DNA, 253 bp, Calothrix sp.
  Nostocophycideae; Rivulariaceae; Calothrix
tacggaggatgcaagcgttatccggaatgattgggcgtaaagcgtccgcaggtggtttgataagtctgctgttaaagcgtgtggctcaaccacatacaggcagtggaaactattcgactagagtatgttaggggtagagggaattcccagtgtagcggtgaaatgcgtagagattgggaagaacaccggtggcgaaagcgctctactaggacaatactgacactgagggacgaaagctaggggagcgaatggg

SEQ ID NO: 2208 - DNA, 253 bp, Unknown
  Description of Unknown: bacterium polynucleotide
  OM190
gacggagggtgcaaacgttgctcggaatcactgggcataaagcgcacgtaggcggttgcctaagttggatgtgaaatcccgtggctcaaccatggaactgcatccgatactgggcgactcgaggaaggttggggtaagtggaactccaggtggagcggtgaaatgcgtagatatcaggaggaacaccggtggcgaaggcggctttctggacagtaactgacgctgagacgcgaaagcgtggggagcaaacagg

SEQ ID NO: 2209 - DNA, 253 bp, Unknown
  Description of Unknown: bacterium polynucleotide
  OM190
tacagagagtgcgaacgttgttcggaattactgggcttaaagcgcacgtaggcggtgtcgtaagtgtcaggtgaaatcccacggctcacccgtggaactgcctggcatactgcgacactcgagtgtggtaggggagagcggaactcctggtggagcggtgaaatgcgtagatatcaggaggaacaccggtggcgaaggcggctctctggtccacaactgacgctgaggtgcgaaagctaggggagcaaacggg

SEQ ID NO: 2210 - DNA, 253 bp, Unknown
  Description of Unknown: bacterium polynucleotide
  OM190
gacagagggtgcaaacgttgctcggaatcactgggcataaagcgcatgtaggcggtctcctaagtctggtgtgaaatccctcggctcaaccggggaactgcattggatactgggaggcttgagagttgtaggggtggacggaactccaggtggagcggtgaaatgcgtagatatctggaggaacaccggaggcgaaagcggtccactgggcaacttctgacgctgagatgcgaaagctagggtagcaaacggg

SEQ ID NO: 2211 - DNA, 253 bp, Unknown
  Description of Unknown: bacterium polynucleotide
  OM190
tacagagggcgcaagcgttattcggattcactgggcataaagagcacgtaggcggctacgtaagtcggatgtgaaatcccgcggctcaaccgcggaatggcatccgatactgcgtggctcgaggtcggaaggggtaagcggaactccaggtggaacggtgaaatgtgtagatatctggaggaacaccggtggcgaaggcggcttactggtccgaatctgacgctgaggtgcgaaagctaggggagcgaacggg

SEQ ID NO: 2212 - DNA, 253 bp, Unknown
  Description of Unknown: bacterium polynucleotide
  OM190
tacagagagtgcgaacgttgttcggaattactgggcttaaagcgcacgtaggcggcgccgcaagtgcggggtgaaatcccacggcttacccgtggaactgccttgcagactgcggtgctcgaggatggtaggggagagcggaactcctggtggagcggtgaaatgcgtagatatcaggaggaacaccggtggcgaaggcggctctctggtccatttctgacgctgaggtgcgaaagctaggggagcaaacggg

SEQ ID NO: 2213 - DNA, 253 bp, Unknown
  Description of Unknown: bacterium polynucleotide
  OM190
gacggagggtgcaaacgttgctcggaatcactgggcataaagcgcacgtaggcggccaactaagtcaggtgtgaaagcccccggctcaaccggggaatggctcctgatactggttggctcgaggacggtaggggtgagtggaactccaggtggagcggtgaaatgcgtagatatcaggaggaacaccggtggcgaaggcgcacatctggcccgatactgacgctcatgcacgaaagcgtggggagcaaacagg

SEQ ID NO: 2214 - DNA, 253 bp, Unknown
  Description of Unknown: bacterium polynucleotide
  OM190
gacagaggttgcaaacgttgttcggaatcactgggcataaagcgcacgtaggcggtctgttaagtcaggtgtgaaagccctcggctcaaccggggaacagcatttgatactggcagactcgaggatggtaggggtgagtggaactccaggtggagcggtgaaatgcgtagatatctggaggaacaccggtggcgaaagcggctcactggaccatcactgacgctgaggtgcgaaagctagggtagcaaacggg

SEQ ID NO: 2215 - DNA, 254 bp, Unknown
  Description of Unknown: bacterium polynucleotide
  OP11-4
gacgtgaggtgcgagcgttatccggattcattgggcgtaaagagttgcgtaggtggatatgcgcattttgttttaaatgctatagctcaactatagtttatggcaaaatatggcgtatcttgaagaatatagaggatgctggaaccaatcgtgtagcagtgaaatgcgttgatatgattgggaacaccaaaggcgtaggcaggcatctgggtatttcttgacactgaggcacgaaagctcggggagcgaaaagg

SEQ ID NO: 2216 - DNA, 253 bp, Unknown
  Description of Unknown: bacterium polynucleotide
  OPB56
tacgtaggacccgagcgttgtccggatttactgggtataaagggtgcgtaggcggtcttgtgcgtcagaggtgaaatctccgggcttaacccggagggtgcctttgatacggcaggacttgagtgcgggagagggtgatggaattcctggtgtagcggtgaaatgcgtagatatcaggaggaacaccggtggcgaaggcggtcacctggcccgtaactgacgctgaggcacgaaagcgtggggatcaaacagg

SEQ ID NO: 2217 - DNA, 253 bp, Unknown
  Description of Unknown: bacterium polynucleotide
  OPB56
tacgtagggcgcaagcgttgtccggattcactgggtgtaaagggtgcgcaggcgggaaagtaagttagaggtgaaatctcacagctcaactgtgaaactgcctttgatactgcttttcttgagttagggagaggttgatggaattccaggtgtagcggtgaaatgcttagatatctggaagaacaccggtggcgaaggcggtcaactggccctaaactgacgctcaggcacgaaagcgtggggatcaaacagg

SEQ ID NO: 2218 - DNA, 253 bp, Unknown
  Description of Unknown: bacterium polynucleotide
  OPB56
tacgtaggacccaagcgttgtccggatttactgggtgtaaagggtgcgcaggcggatgggtaagtcaggggtgaaagtctgcagcttaactgtagaattgcctttgatactgctcatcttgagtttgggagaggttgatggaattccaggtgtagcagtgaaatgcgtagatatctggaagaacaccagtggcgaaggcggtcaactggcccataactgacgctcatgcacgaaagcgtggggagcaaacagg

SEQ ID NO: 2219 - DNA, 254 bp, Unknown
  Description of Unknown: bacterium polynucleotide
  OPB56
tacgtagggtgcgaacgttgtccggaattactgggtgtaaagggtgcacaggcggcttggtgcgtcaggggttaaataccactgctcaacagtggagttgcccttgatacggctgggcttgaatttaagagaggatgatagaattcctggtgtagcggtgaaatgcgtagatatcaggaggaataccagtggcgaaggcggtcatccggcttaattattgacgcttaagcacgaaagcgtgggtagcgaacagg

SEQ ID NO: 2220 - DNA, 253 bp, Unknown
  Description of Unknown: bacterium polynucleotide
  Opitutae
tacagagactgcaagcgttgttcggattcactgggcgtaaagggtgcgcaggcggccaggtgtgtcgggtgtgaaagctcgaggcttaacctcgaaactgcgcccgaaactatttggctagagtactggagagggaggcggaattcacggtgtagcagtgaaatgcgtagatatgcggaggaacaccgatggcgaaggcaatcccctgggcctgcactgacgctcatgcacgaaagcgtggggagcaaacagg

SEQ ID NO: 2221 - DNA, 253 bp, Unknown
  Description of Unknown: bacterium polynucleotide
  Opitutae; Cerasicoccaceae
tacagagactgcaagcgttactcggattcactgggcgtaaagggagcgcaggcggaatcgtgtgtcggatgtgaaacccgggggctcaactcccggactgcgtctgaaactgcgattctagggactcggaggggctagtggaattcttggtggagcagtgaaatgcgtagatatcaagaggaacaccaacggcgaaggcagctagctggacgagatccgacgctcaggctcgaaagtatggggagcaaaaagg

SEQ ID NO: 2222 - DNA, 253 bp, Unknown
  Description of Unknown: bacterium polynucleotide
  Opitutae; Opitutaceae
tacagagactgcaagcgttattcggattcactgggcgtaaagggtgcgcaggcggttgggtgtgtcagatgtgaaatcccgaggctcaacctcggaactgcgtctgaaactactcgactagagtactggagagggtaacggaattcacggtgtagcagtgaaatgcgtagatatcgtgaggaacaccagaggcgaaggcggttacctggacagttactgacgctcaggcacgaaagcatggggagcaaaaggg

SEQ ID NO: 2223 - DNA, 253 bp, Unknown
  Description of Unknown: bacterium polynucleotide
  Opitutae; Opitutaceae
tacggagactgcaagcgttattcggattcactgggcgtaaagggtgcgcaggcggccaagtgtgtcaggtgtgaaatcccgaggcttaacctcggaactgcgcctgaaactacttggctagagtactggagagggtaacggaattcacggtgtagcagtgaaatgcgtagatatcgtgaggaacaccagaggcgaaggcggttacctggacagttactgacgctcaggcacgaaagcgtggggagcaaacagg

SEQ ID NO: 2224 - DNA, 253 bp, Unknown
  Description of Unknown: bacterium polynucleotide
  Opitutae; Opitutaceae
tacagagactgcaagcgttattcggattcactgggcgtaaagggtgcgcaggcggccgagtgtgttagatgtgaaatcccggggctcaaccccggaactgcgtctaaaactacttggctagagtattggagagggtatcggaattcacggtgtggcagtgaaatgcgtagatatcgtgaggaacaccagaggcgaaggcggatacctggacaattactgacgctcaggcacgaaagcgtggggagcaaaaggg

SEQ ID NO: 2225 - DNA, 253 bp, Unknown
  Description of Unknown: bacterium polynucleotide
  Opitutae; Opitutaceae
tacagagactgcaagcgttattcggattcactgggcgtaaagggtgcgcaggcggccagatgtgtcaggtgtgaaagcccggggcttaaccccggaattgcgcctgaaactgtctggctagagtactggagagggtagcggaattcacggtgtagcagtgaaatgcgtagatatcgtgaggaacaccagaggcgaaggcggctacctggacagtaactgacgctcaggcacgaaagcgtggggagcaaaaggg

SEQ ID NO: 2226 - DNA, 253 bp, Unknown
  Description of Unknown: bacterium polynucleotide
  Opitutae; Opitutaceae
tacagagactgcaagcgttattcggattcactgggcgtaaagggtgcgcaggcggccgtgtgtgttaggtgtgaaagcccgaggctcaacctcggaattgcgcctaaaactacacggctagagtattggagagggtagcggaattcacggtgtagcagtgaaatgcgtagatatcgtgaggaacaccagaggcgaaggcggctacctggacaattactgacgctcaggcacgaaagcgtggggagcaaaaggg

SEQ ID NO: 2227 - DNA, 253 bp, Opitutus sp.
  Opitutae; Opitutaceae; Opitutus
tacagagattgcaagcgttattcggattcactgggcgtaaagggtgcgcaggcggccatgtgtgtcaggtgtgaaagcccgaggctcaacctcggaattgcgcctgaaactacatggctagagtactggagagggtagcggaattcatggtgtagcagtgaaatgcgtagatatcatgaggaacaccagaggcgaaggcggctacctggacagttactgacgctcaggcacgaaagcgtggggagcaaaaggg

SEQ ID NO: 2228 - DNA, 253 bp, Opitutus sp.
  Opitutae; Opitutaceae; Opitutus
tacagagactgcaagcgttattcggattcactgggcgtaaagggtgcgcaggtggccaagtgtgtgaggcgtgaaagcccggggcttaaccccggaattgcacctcaaactacatggctagagcattggagagggtagcggaattcacggtgtagcagtgaaatgcgtagatatcgtgaggaacaccagaggcgaaggcggctacctggacaattgcggacgctcatgcacgaaagcgtggggagcaaacagg

SEQ ID NO: 2229 - DNA, 253 bp, Opitutus sp.
  Opitutae; Opitutaceae; Opitutus
tacagagactgcaagcgttattcggattcactgggcgtaaagggtgcgcaggtggccaagtgtgtcaggtgtgaaatcccggggcttaactccggaactgcgcctgaaactgcttggctagagcattggagagggaagtggaattcacggtgtagcagtgaaatgcgtagatatcgtgaggaacaccagaggcgaaggcgacttcctggacaattgctgacactcaggcacgaaagcgtgggtagccaaaggg

SEQ ID NO: 2230 - DNA, 253 bp, Opitutus sp.
  Opitutae; Opitutaceae; Opitutus
tacagagactgcaagcgttattcggattcactgggcgtaaagggtgcgcaggcggccatgtgtgtgaggcgtgaaagcccgatgctcaacatcggaattgcacctcaaactacatggctagagcattggagagggtagcggaattcacggtgtagcagtgaaatgcgtagatatcgtgaggaacaccagaggcgaaggcggctacctggacaattgctgacgctcaggcacgaaagcgtggggagcaaaaggg

SEQ ID NO: 2231 - DNA, 253 bp, Opitutus sp.
  Opitutae; Opitutaceae; Opitutus
tacagagactgcaagcgttattcggattcactgggcgtaaagggtgcgcaggcggccaagtgtgttaggcgtgaaagcccggagctcaactccggaattgcacctaaaactacatggctagagcattggagagggaagcggaattcacggtgtagcagtgaaatgcgtagatatcgagaggaacaccagaggcgaaggcggcttcctggacaattgctgacgctcaggcacgaaagcgtggggagcaaaaggg

SEQ ID NO: 2232 - DNA, 253 bp, Opitutus sp.
  Opitutae; Opitutaceae; Opitutus
tacagagactgcaagcgttattcggattcactgggcgtaaagggtgcgcaggcagccaagtgtgtcaggtgtgaaatcccggggcttaactccggaactgcgcctgaaactacttggctagagcattggagagggaagtggaattcacggtgtagcagtgaaatgcgtaaatatcgtgaggaacaccaggggcgaaggcgacctcctggacaattgctgacgctcaggcacgaaagcgtggggagccaaaggg

SEQ ID NO: 2233 - DNA, 253 bp, Opitutus sp.
  Opitutae; Opitutaceae; Opitutus
tacagagactgcaagcgttattcggattcactgggcgtaaagggtgtgcaggcggcaaaatgtgtggagcgtgaaagcccgaagctcaacttcggaactgcactccaaactattttgctagagcattggagagagtagcagaattcacggtgtagcagtgaaatgcgtagatatcgtgaggaataccagaggcgaaggcggctacttggacaattgctgacgctcaaacacgaaagcgtggggagcaaaaggg

SEQ ID NO: 2234 - DNA, 253 bp, Opitutus sp.
  Opitutae; Opitutaceae; Opitutus
tacagagactgcaagcgttattcggattcactgggcgtaaagggtgcgcaggcggccaagtgtgttaggcgtgaaagcctggggcttaaccccagaattgcacctaaaactacatggctagagcattggagagggtagcggaattcacggtgtagcagtgaaatgcgtagatatcgtgaggaacaccagaggcgaaggcggctacctggacaattgctgacgctcaggcacgaaagcgtggggagcaaaaggg

SEQ ID NO: 2235 - DNA, 253 bp, Opitutus sp.
  Opitutae; Opitutaceae; Opitutus
tacagagactgcaagcgttattcggattcactgggcgtaaagggtgcgcaggcggccgtgtgtgtcagatgtgaaatcccggggcttaactccggaactgcgtctgaaactacacggctagagcattggagagggtagtggaattcacggtgtagcagtgaaatgcgtagatatcgtgaggaacaccagaggcgaaggcgactacctggacaattgctgacgctcaggcacgaaagcgtggggagccaaaggg

SEQ ID NO: 2236 - DNA, 253 bp, Opitutus sp.
  Opitutae; Opitutaceae; Opitutus
tacagagactgcgagcgttattcggattcactgggcgtaaagggtgcgcaggcggccgtgtgtgtcaggtgtgaaatctcgaggcttaacctcgaaattgcgcctgaaactacacggctagagtactggagagggaaacggaattcacggtgtagcagtgaaatgcgtagatatcgtgaggaacaccagaggcgaaggcggtttcctggacagttactgacactgaggcacgaaagctaggggagcaaacagg

SEQ ID NO: 2237 - DNA, 253 bp, Opitutus sp.
  Opitutae; Opitutaceae; Opitutus
tacagagactgcaagcgttattcggattcactgggcgtaaagggtgcgcaggcggccgagtgtgtgaggcgtgaaagcccggggcttaaccccggaattgcacctcaaactacacggctagagcattggagagggtagcagaattcatggtgtagcagtgaaatgcgtagatatcatgaggaataccagaggcgaaggcggctacctggacaattgctgacgctcaggcacgaaagcgtggggagcaaaaggg

SEQ ID NO: 2238 - DNA, 253 bp, Opitutus sp.
  Opitutae; Opitutaceae; Opitutus
tacagagactgcaagcgttattcggattcactgggcgtaaagggtgcgcaggtggccatgtgtgttaggcgtgaaagcccggggcttaaccccggaattgcacctaaaactacatggctagagcattggagaggggagcagaattcacggtgtagcagtgaaatgcgtagatatcgtgaggaataccagaggcgaaggcggctccctggacaattactgacactcaggcacgaaagcgtggggagcaaaaggg

SEQ ID NO: 2239 - DNA, 253 bp, Opitutus sp.
  Opitutae; Opitutaceae; Opitutus
tacagagactgcaagcgttattcggattcactgggcgtaaagggtgcgcaggcggtcgtgtgtgtcaggtgtgaaatcccggagcttaactccggaactgcgcctgaaactacacgactagagcattggagagggaagtggaattcatggtgtagcagtgaaatgcgtagatatcatgaggaacaccagaggcgaaggcgacttcctggacaattgctgacgctcaggcacgaaagcatggggagcaaaaggg

SEQ ID NO: 2240 - DNA, 253 bp, Opitutus sp.
  Opitutae; Opitutaceae; Opitutus
tacagagactgcaagcgttattcggattcactgggcgtaaagggtgcgcaggcggccgtgtgtgtcaggtgtgaaagcccggagcttaactccggaattgcgcctgaaactacatggctagagcattggagagggaagtggaattcacggtgtagcagtgaaatgcgtagatatcgtgaggaacaccagaggcgaaggcgacttcctggacaattgctgacgctcaggcacgaaagcgtggggagcaaaaggg

SEQ ID NO: 2241 - DNA, 253 bp, Unknown
  Description of Unknown: bacterium polynucleotide
  Oscillatoriophycideae
tacggaggatgcaagcgttatccggaatgattgggcgtaaagcgtccgcaggtggtttatcaagtttgcggttaaaggttctggctcaaccaggaacaggccgtgaaaactgatagactagagtatggtaggggcagagggaattcccagtgtagcggtgaaatgcgtagagattgggaagaacaccggtggcgaaagcgctctgctaggccaaaactgacactgagggacgaaagctaggggagcgaatggg

SEQ ID NO: 2242 - DNA, 253 bp, Phormidium sp.
  Oscillatoriophycideae; Phormidiaceae; Phormidium
gacggaggatgcaagcgttatccggaatgattgggcgtaaagcgtccgcaggtggcagttcaagtctgctgtcaaagaccggggcttaacttcggaaaggcagtggaaactgagcagctagagtatggtaggggcagagggaattcctggtgtagcggtgaaatgcgtagagatcaggaagaacatcggtggcgaaggcgctctgctggaccataactgacactcagggacgaaagctaggggagcgaatggg

SEQ ID NO: 2243 - DNA, 253 bp, Phormidium sp.
  Oscillatoriophycideae; Phormidiaceae; Phormidium
gacggaggatgcaagcgttatccggaattattgggcgtaaagcgtccgcaggtggcacttcaagtctgtcgtcaaagactggggcttaaccctggaaaggcggtggaaactgaagcgctagagtgtggtaggggtagagggaattcccggtgtagcggtgaaatgcgtagagatcgggaagaacatcggtggcgaaagcgctctactggaccacaactgacactcagggacgaaagctaggggagcgaatggg

SEQ ID NO: 2244 - DNA, 253 bp, Unknown
  Description of Unknown: bacterium polynucleotide
  Oscillatoriophycideae; Xenococcaceae
tacggaggatgcaagcgttatccggaatgattgggcgtaaagcgtccgcaggtggcatatcaagtctgcggttaaaggttctggctcaaccagagacaggccgtggaaactgataagctagagtatggtaggggcagagggaattcccagtgtagcggtgaaatgcgtagagattgggaagaacaccggtggcgaaagcgctctgctaggccaaaactgacactgagggacgaaagctaggggagcgaatggg

SEQ ID NO: 2245 - DNA, 253 bp, Unknown
  Description of Unknown: bacterium polynucleotide
  Oscillatoriophycideae; Xenococcaceae
tacggaggatgcaagcgttatccggaattattgggcgtaaagcgtccgcaggtggcaattcaagtctgctgttaaaggttctggctcaaccagaaacaggcagtggaaactgaatagctagagtgcggtaggggcagagggaattcccagtgtagcggtgaaatgcgtagagattgggaagaacaccggtggcgaaagcgctctgctaggccgtaactgacactcatggacgaaagctaggggagcgaatggg

SEQ ID NO: 2246 - DNA, 253 bp, Unknown
  Description of Unknown: bacterium polynucleotide
  Oscillatoriophycideae; Xenococcaceae
tacggagggtgcaagcgttatccggaatgattgggcgtaaagcgtccgcaggtggctgttcaagtcgattgtcaaagattggggctcaactccgaaacggcagtggaaactgaacggctagagtgcggtgggggtagagggaattcccggtgtagcggtgaaatgcgtagagatcgggaagaacaccagtggcgaaagcgctctactaagccgcaactgacactcagggacgaaagctaggggagcgaatggg

SEQ ID NO: 2247 - DNA, 253 bp, Chroococcidiopsis sp.
  Oscillatoriophycideae; Xenococcaceae; Chroococcidiopsis
tacggaggatgcaagcgttatccggaatgattgggcgtaaagcgtccgcaggtggcagtgtaagtctgctgtcaaaggtcagggcttaaccctgaacaggcagtggaaactacacagctagagtgcggtgggggcagagggaattcccagtgtagcggtgaaatgcgtagagattgggaagaacaccggtggcgaaagcgctctgctaggccgtaactgacactcatggacgaaagctaggggagcgaatggg

SEQ ID NO: 2248 - DNA, 253 bp, Unknown
  Description of Unknown: bacterium polynucleotide
  PAUC37f
tacgaagggtgcaagcgttaatcggaattactgggcgtaaagggcgcgtaggcggttggataagttggtggtgaaaacctcgagcttaactcggggcctgccatcaatactgcccagctggagtgtgggagaggagagtggaattcccggtgtagcggtgaaatgcgtagatatcgggaggaacaccggtggcgaaggcggctctctggaccacaactgacgctgatgcgcgaaagctaggggagcaaacagg

SEQ ID NO: 2249 - DNA, 253 bp, Unknown
  Description of Unknown: bacterium polynucleotide
  Phycisphaerae
tacagaggccccaagcgttaggcggaatcactgggcttaaagcgtgtgtaggcgggttggtaagtaccttgtgaaatcccacggcttaaccgtggaattgcttggtatactgccgatcttgagtcatttaggggcagccggaacagatggtggagcggtgaaatgcgtagatatcatctggaacgccaatggtgcagacaggctgctgggaatgaactgacgctgaggcacgaaagctaggggagcaaacggg

SEQ ID NO: 2250 - DNA, 253 bp, Unknown
  Description of Unknown: bacterium polynucleotide
  Phycisphaerae
gacagaggtgccgagcgttaggcggaatcactgggcttaaagcgtgtgtaggcgggtcgttaagtgccttgtgaaatcccacagctcacctgtggaactgcttggcatactggcgatcttgagccacttaggggcaaccggaacaaacggtggagcggtgaaatgcgtagatatcgtttggaacgccaatggtgaaaacaggttgctgggagtgcgctgacgctgagacacgaaagccaggggagcaaacggg

SEQ ID NO: 2251 - DNA, 253 bp, Unknown
  Description of Unknown: bacterium polynucleotide
  Phycisphaerae
tacagaggtctcgagcgttaggcggaatcactgggcttaaagcgtgtgtaggcggatcggtaagtaccttgtgaaatcccacagcttaactgtggaactgcttggtatactgccagtcttgagccacttaggggctaccggaacaaatggtggagcggtgaaatgcgtagatatcatttggaacgccaatggtgaaaacaggtagctgggagtgtgctgacgctgagacacgaaagccaggggagcaaacggg

SEQ ID NO: 2252 - DNA, 253 bp, Unknown
  Description of Unknown: bacterium polynucleotide
  Phycisphaerae
tacagaggcctcgagcgttgcgcggaatcactgggcttaaagggtgcgtaggcggatgtgcaagtgccttgtgaaatccccgggctcaacccgggaactgcttggtagactgcatgtcttgaggtcggtaggggttgctggaacagttggtggagcggtgaaatgcgtagatatcaactggaacgccaaaggcgaaggcaagcaactgggccgattctgacgctgaggcacgaaagcgtggggagcaaacggg

SEQ ID NO: 2253 - DNA, 253 bp, Unknown
  Description of Unknown: bacterium polynucleotide
  Phycisphaerae
gacagaggtgccgagcgttaggcggaatcactgggcttaaagcgtgtgtaggcgggtttctaagtaccttgtgaaatcccacggctcaaccgtggaactgctgggtatactgggaatcttgagccacttaggggcaaccggaacaaatggtggagcggtgaaatgcgtagatatcatttggaacgccaatggtgaaaacaggttgctgggagtgtgctgacgctgagacacgaaagccaggggagcgaacggg

SEQ ID NO: 2254 - DNA, 253 bp, Unknown
  Description of Unknown: bacterium polynucleotide
  Phycisphaerae
tacagaggcctcgagcgttaggcggaatcactgggcttaaagcgtgtgtaggcggacttctaagtaccttgtgaaatcccacggcttacccgtggaactgctgggtatactggttgtcttgagctttctaggggcgagcggaacaaatggtggagcggtgaaatgcgtagatatcatttggaacgccaatggtgaaaacagctcgctggggaaatgctgacgctgagacacgaaagccaggggagcgaacggg

SEQ ID NO: 2255 - DNA, 253 bp, Unknown
  Description of Unknown: bacterium polynucleotide
  Phycisphaerae
gacagaggtgccaagcgttaggcggaatcactgggcttaaagcgtgtgtaggcggatcgttaagtaccttgtgaaatcccacggctcaaccgtggaactgctgggtatactggcggtcttgagccacctaggggcgagcggaacaaacggaggagcggtgaaatgcgtagatatcgtttggaacgccaacggtgaaaacagctcgctgggggtgtgctgacgctgagacacgaaagccaggggagcgaacggg

SEQ ID NO: 2256 - DNA, 253 bp, Unknown
  Description of Unknown: bacterium polynucleotide
  Phycisphaerae
gacagaggcctcaagcgttaggcggaatcactgggcttaaagcgtgtgtaggcggatcgttaagtgtcttgtgaaatcccacggctcacccgtggaactgctgggcatactggcgatcttgggccaactaggggcaactggaacaagcggtggagcggtgaaatgcgtagatatcgcttggaacgccaaaggtgaaaacaggttgctggggttgtgccgacgctgagacacgaaagccaggggagcaaacggg

SEQ ID NO: 2257 - DNA, 253 bp, Unknown
  Description of Unknown: bacterium polynucleotide
  Phycisphaerae
gacagaggtcccgagcgttaggcggaatcactgggcttaaagcgtgtgtaggcggatcgttaagtaccttgtgaaatcccacggcttaaccgtgaaactgcttggtatactggcgatcttgagccacttaggggctaccggaacaaatggtggagcggtgaaatgcgtagatatcatttggaacgccaatggtgaaaacaggtagctgggagtgtgctgacgctgagacacgaaagccaggggagcaaacggg

SEQ ID NO: 2258 - DNA, 253 bp, Unknown
  Description of Unknown: bacterium polynucleotide
  Phycisphaerae
tacagaggcctcgagcgttaggcggaatcactgggcttaaagcgtgtgtaggcggacttctaagtaccttgtgaaatcccacggcttacccgtggaactgctgggtatactggttgtcttgagccacttaggggctaccggaacaaatggtggagcggtgaaatgcgtagatatcatttggaacgccaatggtgaaaacaggtagctgggagtgtgctgacgctgagacacgaaagccaggggagcgaacggg

SEQ ID NO: 2259 - DNA, 253 bp, Unknown
  Description of Unknown: bacterium polynucleotide
  Phycisphaerae
gacagaggtgccgagcgttaggcggaatcactgggcttaaagcgtgtgtaggcgggcgatcaagtaccttgtgaaatcccacggctcaaccgtggaaccgctgggtatactggttgtcttgagccggctaagggcgagcggaacagacggtggagcggtgaaatgcgtagatatcgtctggaacgccaaaggtgaaaacagctcgctggggccgcgctgacgctgagacacgaaagccaggggagcgaacggg

SEQ ID NO: 2260 - DNA, 253 bp, Unknown
  Description of Unknown: bacterium polynucleotide
  Phycisphaerae
gacagaggtgcctagcgttaggcggaatcactgggcttaaagcgtgtgtaggtggaagggtaagtaccttgtgaaatcccacggcttaaccgtggaactgctgggtatactgcttttcttgagccaactaggggttaccggaacaaatggtggagcggtgaaatgcgtagatatcatttggaacgccaatggtgaaaacaggtaactggggttgtgctgacactgagacacgaaagccaggggagcaaacggg

SEQ ID NO: 2261 - DNA, 253 bp, Unknown
  Description of Unknown: bacterium polynucleotide
  Phycisphaerae
gacagaggtgccgagcgttaggcggaatcactgggcttaaagcgtgtgtaggcggatttgtaagtaccttgtgaaatcccatggctcaaccatggaactgctcggtatactgcttatcttgagccacttaggggcagtcggaacagatggtggagcggtgaagtgcgtagatatcatctggaacgccaaaggtgaaaacagactgctgggagtgtgctgacgctgagacacgaaagctaggggagcgaacggg

SEQ ID NO: 2262 - DNA, 253 bp, Unknown
  Description of Unknown: bacterium polynucleotide
  Phycisphaerae
gacagaggtgccaagcgttaggcggaatcaccgggcttaaagcgtgtgtaggcggattggtaagtaccttgtgaaatcccacagctcaactgtggaactgctcggtatactgcttatcttgagccacttaggggctgtcggaacaaatggtggagcggtgaaatgcgtagatatcatttggaacgccaaaggtgaaaacagacagctgggagtgtgctgacgctgagacacgaaagccaggggagcgaacggg

SEQ ID NO: 2263 - DNA, 253 bp, Unknown
  Description of Unknown: bacterium polynucleotide
  Phycisphaerae
gacagaggtgccgagcgttagggggaatcactgggcttaaagcgtgtgtaggcggcgggtgaagtaccttgtgaaatcccacggctcaaccgtggaactgctgggtatactggcccgcttgagccacctaggggcgagcggaacaaatggtggagcggtgaaatgcgtagatatcatttggaacgccaatggtgaaaacagctcgctgggggtgtgctgacgctgagacacgaaagccaggggagcgaacggg

SEQ ID NO: 2264 - DNA, 253 bp, Unknown
  Description of Unknown: bacterium polynucleotide
  Phycisphaerae
gacagaggtgccaagcgttaggcggaatcactgggcttaaagcgtgtgtaggcggacttgtaagtaccttgtgaaatcccacggcttaaccgtggaactgcttggtatactgcttgtcttgagccacttaggggctaccggaacaaatggtggagcggtgaaatgcgtagatatcatttggaacgccaatggtgaaaacaggtagctgggagtgtgctgacgctgagacacgaaagccaggggagcgaacggg

SEQ ID NO: 2265 - DNA, 253 bp, Unknown
  Description of Unknown: bacterium polynucleotide
  Phycisphaerae
tacagaggtctcgagcgttagtcggaatcattgggcttaaagcgtacgtaggcggatatgcaggcgtcgtgtgaaagccctcggctcaaccgaggaattgcacggcgaaccgcatgtcttgagacaagtaggggctgtcggaacgataggtggagtggtgaaatgcgttgatatctatcggaacgccgatggtgaaaacagacagctgggcttgttctgacgctgaggtacgaaagcgtggggagcgaacggc

SEQ ID NO: 2266 - DNA, 253 bp, Unknown
  Description of Unknown: bacterium polynucleotide
  Phycisphaerae
tacgaagggggctagcgttgctcggaatcactgggcgtaaagggtgcgtaggcgggcccgtaagtgtcttgtgaaatcccacggctcaaccgtggaactgctgggcatactgcgggtcttgggccaactaggggcagccggaacaagcggtggagcggtgaaatgcgtagatatcgcttggaacgccgaaggtgaaaacaggctgctggggttgcgccgacgctgagacacgaaagccaggggagcaaacggg

SEQ ID NO: 2267 - DNA, 253 bp, Unknown
  Description of Unknown: bacterium polynucleotide
  Phycisphaerae
tacagaggcctcgagcgttaggcggaatcactgggcttaaagcgtgtgtaggcggatgcctaagtaccttgtgaaatcccacggcttacccgtggaacggctgggtatactgggcgtcttgagccacttaggggctgccggaacaaatggtggagcggtgaaatgcgtagatatcatttggaacgccaatggtgaaaacaggcagctgggggtgtgctgacgctgagacacgaaagccaggggagcaaacggg

SEQ ID NO: 2268 - DNA, 253 bp, Unknown
  Description of Unknown: bacterium polynucleotide
  Phycisphaerae
gacagaggtgccgagcgttaggcggaatcactgggcttaaagcgtgtgtaggcggattcctaagtaccttgtgaaatcccacggcttaaccgtggaactgcttggtatactgggtgtcttgagccaactagaggcaatcggaacaaacggtggagcggtgaaatgcgtagatatcgtttggaacgccaatggtgaaaacagattgctggggttgtgctgacgctgagacacgaaagccaggggagcgaacggg

SEQ ID NO: 2269 - DNA, 253 bp, Unknown
  Description of Unknown: bacterium polynucleotide
  Phycisphaerae
gacagaggtgccgagcgttaggcggaatcactgggcttaaagcgtgtgtaggcggatctgtaagtaccttgtgaaatcccacggctcaaccgtggaactgcttggtatactgcggatcttgagccacctaggggcaagtggaacaaacggtggagcggtgaaatgcgtagatatcgtttggaacgccaatggtgaaaacaacttgctgggggtgtgctgacgctgagacacgaaagccaggggagcaaacggg

SEQ ID NO: 2270 - DNA, 253 bp, Unknown
  Description of Unknown: bacterium polynucleotide
  Phycisphaerae
tacagaggcctcgagcgttaggcggaatcactgggcttaaagcgtgtgtaggcggacttctaagtaccttgtgaaatcccacagcttaactgtggaactgcttggtatactggttgtcttgaggtacctaggggcgagcggaacaagtggtggagcggtgaaatgcgtagatatcacttggaacgccaacggtgaaaacagctcgctgggggtatcctgacgctgagacacgaaagccaggggagcaaacggg

SEQ ID NO: 2271 - DNA, 253 bp, Unknown
  Description of Unknown: bacterium polynucleotide
  Phycisphaerae
gacagaggcctcgggcgttaggcggaatcactgggcttaaagcgtgtgtaggcggatcgttaagtgccttgtgaaatcccacggcttaactgtggaacggctgggcatactggcggtcttgagccatctaggggcgactggaacaaacggaggagcggtgaaatgcgtagatatcgtttggaacgccaatggtgaaaacaggtcgctggggatgagctgacgctgagacacgaaagccaggggagcaaacggg

SEQ ID NO: 2272 - DNA, 253 bp, Unknown
  Description of Unknown: bacterium polynucleotide
  Phycisphaerae
tacagggggctcgagcgttagtcggaatcactgggcttaaagggtgcgtaggcggcccgccaagtgctttgtgaaatccccgagctcaactcgggaacagcagggcaaactggcgggcttgaagcaggtaggggctggaagaacagtaggtggagcggtgaaatgcgtagatatctactggaatgccgatggggaagccgtccagctgggcctgtcttgacgctgaggcacgaaagcgtggggagcaaacagg

SEQ ID NO: 2273 - DNA, 253 bp, Unknown
  Description of Unknown: bacterium polynucleotide
  Phycisphaerae
tacggggggagcaagcgttgttcggatttactgggcgtaaagggtgcgtaggcgggtcagaaagcgtcttgtgaaatcccccggctcaaccggggaacagcagggcgaactactggccttgaggaaggtagaggccggcagaacgatcggtggagcggtggaatgcgtagagatcgatcggaatgccaaaggtgaagacagccggctgggcctttcctgacgctgaggcacgaaagcgtggggagcaaacagg

SEQ ID NO: 2274 - DNA, 253 bp, Unknown
  Description of Unknown: bacterium polynucleotide
  Phycisphaerae
tacagaggtcccgagcgttaggcggaatcactgggcttaaagcgtgtgtaggcggatcggtaagtaccttgtgaaatcccacggcttaaccgtggaactgcttggtatactgccagtcttgaggcagctaggggctaccggaacaaatggtggagcggtgaaatgcgtagatatcatttggaacgccaatggtgaaaacaggtagctggggctgtgctgacgctgagacacgaaagccaggggagcgaacggg

SEQ ID NO: 2275 - DNA, 253 bp, Unknown
  Description of Unknown: bacterium polynucleotide
  Phycisphaerae
gacagaggcctcaagcgttaggcggaatcactgggcttaaagcgtgtgtaggcggacgcctaagtgtcttgtgaaatcccacggctcacccgtggaactgctgggcatactgggcgtcttgggccaactaggggcaactggaacaagcggtggagcggtgaaatgcgtagatatcgcttggaacgccgaaggtgaaaacaggttgctggggttgtgccgacgctgagacacgaaagcgtggggagcaaacagg

SEQ ID NO: 2276 - DNA, 253 bp, Unknown
  Description of Unknown: bacterium polynucleotide
  Phycisphaerae
gacagaggtgccgagcgttaggcggaatcactgggcttaaagcgtgtgtaggcgggtcgttaagtgctttgtgaaatcccccggctcaaccggggaaccgctgggcatactggcgaccttgagaggcctaggggccatcggaacaagcggtggagcggtgaaatgcgtagatatcgcttggaacgccggcggcgaaagcggatggctgggggccttctgacgctgagacacgaaagccaggggagcgaacggg

SEQ ID NO: 2277 - DNA, 253 bp, Unknown
  Description of Unknown: bacterium polynucleotide
  Phycisphaerae
tacagaggctacgagcgttaggcggaatcactgggcttaaagcgtgtgtaggtggatgggtaagtaccttgtgaaatcccacggctcaaccatggaactgctcggtatactgcctgtcttgaggcactcaggggcgagcggaacagatggtggagcggtgaaatgcgtagatatcatctggaacgccaatggtgaagacagctcgctgggggtgtactgacactgagacacgaaagccaggggagcaaacggg

SEQ ID NO: 2278 - DNA, 253 bp, Unknown
  Description of Unknown: bacterium polynucleotide
  Phycisphaerae
gacagaggtgccgagcgttaggcggaatcactgggcttaaagcgtgtgtaggcggcccgttaagtaccttgtgaaatcccgcggctcaaccgcggaacggctgggtatactggcgggcttgagcggcctaggggcagatggaacaagtggaggagcggtgaaatgcgtagatatcacttggaacgccaaaggtgaagacagtctgctgggggcctgctgacgctgagacacgaaagccaggggagcgaacggg

SEQ ID NO: 2279 - DNA, 253 bp, Unknown
  Description of Unknown: bacterium polynucleotide
  Phycisphaerae
tacagaggtgccaagcgttaggcggaatcactgggcttaaagcgcgtgtaggtggacgggtaagtatcttgtgaaatcccacggctcaaccgtggaactgctggatatactgcttgtcttgaggcacttaggggcagctggaacaaatggtggagcggtgaaatgcgtagatatcatttggaacgccaaaggcgaaagcaggctgctgggagtgatctgacactgagacgcgaaagccaggggagcaaacggg

SEQ ID NO: 2280 - DNA, 253 bp, Unknown
  Description of Unknown: bacterium polynucleotide
  Phycisphaerae
tacagaggtctcgagcgttaggcggaatcactgggcttaaagcgtgtgtaggcggatccgtaagtaccttgtgaaatcccacggcttaaccgtggaactgctgggtatactgcgggtcttgagccacctaggggcgagcggaacagatggtggagcggtgaaatgcgtagatatcatctggaacgccaacggtgaaaacagctcgctgggggtgtgctgacgctgagacacgaaagccaggggagcaaacggg

SEQ ID NO: 2281 - DNA, 253 bp, Unknown
  Description of Unknown: bacterium polynucleotide
  Phycisphaerae
gacagaggtcccgagcgttaggcggaatcactgggcttaaagcgtgtgtaggcggatttgtaagtaccttgtgaaatcccacggctcaaccgtggaactgcttggtatactgcttatcttgggccatctaggggctaccggaacaagtggtggagcggtgaaatgcgtagatatcacttggaacgccaatggtgaaaacaggtagctggggatgtgccgacgctgagacacgaaagccaggggagcaaacggg

SEQ ID NO: 2282 - DNA, 253 bp, Unknown
  Description of Unknown: bacterium polynucleotide
  Phycisphaerae
gacagaggccccaagcgttaggcggaatcactgggcttaaagcgtgtgtaggcggacgcctaagtgtcttgtgaaatcccccggctcacccggggaactgctgggcatactgggcgtcttgggccaactaggggcagccggaacaagcggtggagcggtgaaatgcgtagatatcgcttggaacgccgaaggtgaaaacaggctgctggggttgcgccgacgctgagacacgaaagccaggggagcaaacggg

SEQ ID NO: 2283 - DNA, 253 bp, Unknown
  Description of Unknown: bacterium polynucleotide
  Phycisphaerae
gacagaggtgccgagcgttaggcggaatcactgggcttaaagcgtgtgtaggcgggtcgttaagtgtcttgtgaaatcccaccgctcaacggtggaacggctgggcatactggcgatcttgagccacctaggggcgagcggaacaagcggtggagcggtgaaatgcgtagatatcgcttggaacgccgacggtgaaaacagctcgctgggggtgtgctgacgctgagacacgaaagccaggggagcggacggg

SEQ ID NO: 2284 - DNA, 253 bp, Unknown
  Description of Unknown: bacterium polynucleotide
  Phycisphaerae
gacagaggtgccgagcgttaggcggaatcactgggcttaaagcgtgtgtaggcggcccgttaagtgtcccgtgaaatcccccggctcaaccggggaaccgcggggcatactggcgggcttgggtcgctcaggggcaagcggaacaggcggaggagcggtgaaatgcgtagatatcgcctggaacgccgaaggtgaaaacagcttgctgggggcgtaccgacgctgagacacgaaagccaggggagcgaacggg

SEQ ID NO: 2285 - DNA, 253 bp, Unknown
  Description of Unknown: bacterium polynucleotide
  Phycisphaerae
gacagaggcctcaagcgttaggcggaatcactgggcttaaagcgtgtgtaggcggacccctaagtaccttgtgaaatcccacggctcaaccgtggaacggctgggtatactgggggtcttgggccattcaggggcgactggaacaagcggtggagcggtgaaatgcgtagatatcgcttggaacgccgaaggtgaaaacaggtcgctggggatgtgccgacgctgagacacgaaagccaggggagcaaacggg

SEQ ID NO: 2286 - DNA, 253 bp, Unknown
  Description of Unknown: bacterium polynucleotide
  Phycisphaerae
tacagaggtgccaagcgttaggcggaatcactgggcttaaagcgcgcgtaggcggaccgttaagtgtcttgtgaaatcccacagctcaactgtggaactgcttggcagactggcggtcttgaggtgctcaggggcgagtggaacaagtggtggagcggtgaaatgcgtagatatcacttggaacgccaaaggtgaaaacagctcgctgggggcatcctgacgctgaggcgcgaaagccaggggagcaaacggg

SEQ ID NO: 2287 - DNA, 253 bp, Unknown
  Description of Unknown: bacterium polynucleotide
  Phycisphaerae
tacagaggtcccaagcgttactgagaatcactgggtttaaagggtgcgtaggtggtccgttaagttcgttgtgaaatccctgggctcaacccaggaactgcttcgaatactggcggacttgaggccggtaggggtcactggaactgacggtggagcggtgaaatgcgtagatatcgtcaggaacgccggtggtgaagacgggtgacttggccggttctgacactgaggcacgaaagcgtggggagcgaacggg

SEQ ID NO: 2288 - DNA, 253 bp, Unknown
  Description of Unknown: bacterium polynucleotide
  Phycisphaerae; Phycisphaeraceae
tacagaggtctcaagcgttaatcggaattactgggcttaaagggtccgcaggcggtccgacaagtaccttgtgaaatatcaggtctcaaccctgaaattgctgggtagactgccggacttgagtgcaaaaggggtcgctggaactctaggtggagcggtgaaatgcgtagatatctagaggaacgccaaaggtgaagacaggcgactggtttgcaactgacgctcatggacgaaagcgtggggatcaaacggg

SEQ ID NO: 2289 - DNA, 253 bp, Unknown
  Description of Unknown: bacterium polynucleotide
  Pla4
tacggagagtgcaaacgttgttcggattcactgggcgtaaagggcacgtaggcggctcagcaaatcggtcgtggaatcccgacgcttaccgtcggaacggcggccgaaaatactgggctagagggcgtgaggggtcactggaactcctggtgaagcggtgaaatgcgtagatatcaggaggaacgccggaggcgaaagcgagtgactggcgcgttcctgacgctgaggtgcgaaagctaggggagcaaacagg

SEQ ID NO: 2290 - DNA, 254 bp, Unknown
  Description of Unknown: bacterium polynucleotide
  Planctomycetia
gacgaaccgtgcgaacgttattcggaatcactgggcttaaagcgtgcgtaggcggcattgtaagttaggggtgaaatcccatcggctcaaccgtggaactgcctttaatactgcaatgcttgagggaggtaggggaatgtggaacttccagtggagcggtgaaatgtgttgagattggaaggaacgccagtggcgaaagcgacattctggatcttttctgacgctgaggcacgaaagctagggtagcgaacagg

SEQ ID NO: 2291 - DNA, 253 bp, Unknown
  Description of Unknown: bacterium polynucleotide
  Planctomycetia; Gemmataceae
gacgaaccgtgcgaacgttgttcggaatcactgggcttaaagggcgcgtaggcggacaatcaagtcaggggtgaaatcccacggctcaaccgtggaagtgcctttgatactgactgtctcgagggaggtaggggcgtgcggaacttccggtggagcggtgaaatgcgtagatatcggaaggaacgccggtggcgaaagcggcgcgctggacctcttctgacgctgaggcgcgaaagctaggggagcaaacggg

SEQ ID NO: 2292 - DNA, 253 bp, Unknown
  Description of Unknown: bacterium polynucleotide
  Planctomycetia; Gemmataceae
gacgaaccgtgcaaacgttattcggaatcactgggcataaagggcgcgtaggcggctccaaaagtcaggggtgaaatccggcagcttaactgtcgcagtgcctttgatactgtggagctagagggaggtaggggtctgtggaacttccggtggagcggtgaaatgcgttgatatcggaaggaacgccggtggcgaaagcgacggactggatctcttctgacgctgaggcgcgaaagccaggggagcaaacggg

SEQ ID NO: 2293 - DNA, 253 bp, Unknown
  Description of Unknown: bacterium polynucleotide
  Planctomycetia; Gemmataceae
gacgaaccgtgcaaacgttgttcggaatcactgggcttaaagggcgcgtaggcgggtggtcaagtcaggggtgaaatcctccagctcaactggagaacagcttttgatactggccatcttgaggggggtaggggcatgtggaacttccggtggagcggtgaaatgcgtagatatcggaaggaacgccggtggcgaaagcgacgtgctggaccctttctgacgctgaggcgcgaaagccaggggagcaaacggg

SEQ ID NO: 2294 - DNA, 253 bp, Unknown
  Description of Unknown: bacterium polynucleotide
  Planctomycetia; Gemmataceae
gacgaactgtcctaacgttgttcggaatcactgggcttaaagggcgcgtaggcggtccgacaagtcaggggtgaaatcctgcagcttaactgcagaagtgcctttgatactgtcggtctcgagggagataggggtgtgcggaacttccagtggagcggtgaaatgcgttgatattggaaggaacgccggaggcgaaagcggcgcactggatctcttctgacgctgaggcgcgaaagctaggggagcaaacggg

SEQ ID NO: 2295 - DNA, 253 bp, Unknown
  Description of Unknown: bacterium polynucleotide
  Planctomycetia; Gemmataceae
tacgaaccgtgcgaacgttgttcggattcactgggcttaaagggcgcgtaggcgggttgtcaagtcgggggtgaaatctttcagctcaactggaaaagtgcctccgatactgatgacctcgagggaggtaggggcatgtggaacttccggtggagcggtgaaatgcgtagatatcggaaggaacgccggtggcgaaagcgacgtgctggatctcttctgacgctgaggcgcgaaagctaggggagcaaacggg

SEQ ID NO: 2296 - DNA, 253 bp, Unknown
  Description of Unknown: bacterium polynucleotide
  Planctomycetia; Gemmataceae
gacgaaccgtgcgaacgttgttcggaatcactgggtttaaagggcgcgtaggcgggctgtcaagtcggtggtgaaatctttcagcttaactggaaaatggccttcgatactggcggcctggagggaggtaggggcatgcggaacttccggtggagcggtgaaatgcgtagatatcggaaggaacaccgatggcgaaagcagcgtgctggaccttttctgacgctgaggcgcgaaagccaggggagcaaacggg

SEQ ID NO: 2297 - DNA, 253 bp, Unknown
  Description of Unknown: bacterium polynucleotide
  Planctomycetia; Gemmataceae
gacgaaccgtgcgaacgttgttcggattcactgggcttaaagggcgcgtaggcggggggtcaagtccgaggtgaaatctttcggctcaaccggaaaagtgcctcggatactgatctcctcgaggggggtaggggcatgtggaacttccggtggagcggtgaaatgcgtagatatcggaaggaacgccggtggcgaaagcgacgtgctggaccccttctgacgctgaggcgcgaaagccaggggagcaaacggg

SEQ ID NO: 2298 - DNA, 253 bp, Unknown
  Description of Unknown: bacterium polynucleotide
  Planctomycetia; Gemmataceae
gacgaaccgtgcgaacgttattcggaatcactgggcttaaagggtgcgtaggcgggcgtccaagtcaggggtgaaatcccacggctcaaccgtggaagtgcctctgatactgggcgcctcgaggggtgcaggggcgtgcggaactcagggtggagcggtgaaatgcgtagatatcctgaggaacaccggtggcgaaagcggcgcgctagacaccttctgacgctgaggcacgaaagccaggggagcaaacggg

SEQ ID NO: 2299 - DNA, 253 bp, Unknown
  Description of Unknown: bacterium polynucleotide
  Planctomycetia; Gemmataceae
gacgaaccgtgcgaacgttgttcggaatcactgggcttaaagggcgcgtaggcgggcggtcaagtcagaggtgaaatcccacggctcaaccgtggaagtgcccctgatactggtcgtctcgagggaggtaggggcgtgcggaacttccggtggagcggtgaaatgcgtagatatcggaaggaacaccggtggcgaaagcggcgcgctggacctcttctgacgctgatgcgcgaaagccaggggagcaaacggg

SEQ ID NO: 2300 - DNA, 253 bp, Gemmata sp.
  Planctomycetia; Gemmataceae; Gemmata
gacgaaccgagcgaacgttgttcggaatcactgggcttaaagggcgcgtaggcgggctgccaagtctggggtgaaatcccgcggctcaaccgtggaactgcctcagatactggcggcctcgagggagataggggcgagcggaactaatggtggagcggtgaaatgcgttgatatcattaggaactccggtggcgaaggcggctcgctggatcttttctgacgctgaggcgcgaaagctaggggagcaaacggg

SEQ ID NO: 2301 - DNA, 253 bp, Gemmata sp.
  Planctomycetia; Gemmataceae; Gemmata
gacgaaccgagcgaacgttgttcggaatcactgggcttaaagggcgcgtaggcgggctgtcaagtctggggtgaaatcccgcggctcaaccgtggaactgcctcagatactgacggtctcgagggaggtaggggcgagcggaactgatggtggagcggtgaaatgcgttgatatcatcaggaactccggtggcgaaggcggctcgctggacctcttctgacgctgaggcgcgaaagccaggggagcaaacggg

SEQ ID NO: 2302 - DNA, 253 bp, Gemmata sp.
  Planctomycetia; Gemmataceae; Gemmata
gacgaaccgtgcgaacgttgttcggaatcactgggcttaaagggagcgtaggcgggctatcaagtctggggtgaaatcccacggctcaaccgtggaactgccttagatactgacggcctcgagggagataggggcatgcggaactgtaggtggagcggtgaaatgcgttgatatctacaggaactccggtggcgaaagcggcgtgctggatctcttctgacgctgaggctcgaaagctaggggagcaaacggg

SEQ ID NO: 2303 - DNA, 253 bp, Gemmata sp.
  Planctomycetia; Gemmataceae; Gemmata
gacgaaccgtgcgaacgttgttcggaatcactgggcttaaagggcgcgtaggcgggtcgccaagtttggggtgaaatcctccggctcaaccggagaactgcctcaaatactggcgatctcgagggggataggggcatgcggaactacgggtggagcggtgaaatgcgttgatatccgtaggaactccggtggcgaaggcggcgtgctggatcccttctgacgctgaggcgcgaaagccaggggagcaaacggg

SEQ ID NO: 2304 - DNA, 253 bp, Gemmata sp.
  Planctomycetia; Gemmataceae; Gemmata
gacgaaccgtccgaacgttattcggaatcactgggcttaaagggcgcgtaggcgggccgccaagtccggggtgaaatactccagcttaactggagaactgccccggatactggaggtctcgagggagataggggcacacggaacttatggtggagcggtgaaatgcgttgatatcataaggaactccggtggcgaaggcggtgtgctggatctcttctgacgctgaggcgcgaaagccaggggagcaaacggg

SEQ ID NO: 2305 - DNA, 253 bp, Gemmata sp.
  Planctomycetia; Gemmataceae; Gemmata
gacgaaccgagcgaacgttgttcggaatcactgggcttaaagggcgcgtaggcgggtactcaagtccgtggtgaaatcctccggctcaaccggagaactgcctcggatactgaatgtctcgagggtgataggggtatgcggaactatcggtggagcggtgaaatgcgttgatatcgataggaactccggtggcgaaggcggcatactggatcacctctgacgctgaggcgcgagagcgtggggagcgaacagg

SEQ ID NO: 2306 - DNA, 253 bp, Gemmata sp.
  Planctomycetia; Gemmataceae; Gemmata
gacgaaccgagcgaacgttgttcggaatcactgggcttaaagggcgcgtaggcgggtgctcaagtccggggtgaaatcctccagctcaactggagaactgcctcggatactgggtgcctcgagggtggcaggggtatgcggaactatcggtggagcggtgaaatgcgttgatatcgataggaactccggtggcgaaggcggcatactggtccacttctgacgctgaggcgcgaaagccaggggagcaaacggg

SEQ ID NO: 2307 - DNA, 253 bp, Gemmata sp.
  Planctomycetia; Gemmataceae; Gemmata
gacgaaccgagcgaacgttgttcggaatcactgggcttaaagggcgcgtaggcgggttgtctagtccagggtgaaatcccacagctcaactgtggaactgcctcggatactggcagtctcgagggtggtaggggtatgcggaactatcggtggagcggtgaaatgcgttgatatcgataggaactccggtggcgaaggcggcatactggaccacttctgacgctgatgcgcgaaagccaggggagcaaacggg

SEQ ID NO: 2308 - DNA, 253 bp, Gemmata sp.
  Planctomycetia; Gemmataceae; Gemmata
gacgaaccgtgcgaacgttgttcggaatcactgggcttaaagggcgcgtaggcggcccgccgcgtccggggtgaaatcccgcggctcaaccgcggaaccgcctcgggtacgggcgggctggaggcgggtaggggcacgcggaacagtgggaggagcggtgaaatgcgttgatgtccactggaactccggtggcgaaggcggcgtgctggacccgatctgacgctgaggcgcgaaagccaggggagcgaacggg

SEQ ID NO: 2309 - DNA, 253 bp, Gemmata sp.
  Planctomycetia; Gemmataceae; Gemmata
gacgaaccgtgcgaacgttgttcggaatcactgggcttaaagggcgcgtaggcgggctgtcaagtctggggtgaaatcccgcggctcaaccgtggaactgcctcagatactgacggcctcgagggaggtaggggcatgcggaactgtaggtggagcggtgaaatgcgttgatatctacaggaactccggtggcgaaggcggcgtgctggacctcttctgacgctgaggcgagaaagctaggggagcaaacggg

SEQ ID NO: 2310 - DNA, 253 bp, Gemmata sp.
  Planctomycetia; Gemmataceae; Gemmata
gacgaaccgagcgaacgttgttcggaatcactgggcttaaagggcgcgtaggcgggcatcatagtctgtggtgaaatccggcagcttaactgtcgaattgccatggatactgggtgtctcgagggaggcaggggtgcgcggaactgatggtggagcggtgaaatgcgttgatatcatcaggaactccggtggcgaaggcggcgcactggtccttttctgacgctgaggcgcgaaagccaggggagcaaacggg

SEQ ID NO: 2311 - DNA, 253 bp, Gemmata sp.
  Planctomycetia; Gemmataceae; Gemmata
gacgaaccgtgcgaacgttgttcggtatcactgggcttgaagggcgcgtaggcggactgtcaagtccggggtgaaatcctcccgctcaacgggagaacggccccggatactgccggtctcgaggcgggtaggggcgtgcggaactatgggaggagcggtgaaatgcattgatatccataggaactccggtggcgaaggcggcacgctggacccgatctgacgctgaggcgcgaaagccaggggagcgaacggg

SEQ ID NO: 2312 - DNA, 253 bp, Gemmata sp.
  Planctomycetia; Gemmataceae; Gemmata
gacgaaccgagcgaacgttgttcggaatcactgggcttaaagggtgcgtaggcgggctgccaagtttggggtgaaatcctccggctcaaccggggaagtgccttgaatactggcggtctcgagggaggtaggggcgtgcggaactaacggtggagcggtgaaatgcgttgatatcgttaggaactccggtggcgaaggcggcacgctggacctcatctgacgctgaggcacgaaagccaggggagcgaacggg

SEQ ID NO: 2313 - DNA, 254 bp, Unknown
  Description of Unknown: bacterium polynucleotide
  Planctomycetia; Isosphaeraceae
gacgaaccgtgcgaacgttattcggaatcactgggcttaaagcgcgtgtaggcggattggaacgtcggcgcctgaaatcccccggctcaaccggggaacgcggcccgaaacgaccagtctggagggacgtaggggggactggaacttccggtggagcggtgaaatgcgttgagatcggaaggaacgcccgtggcgaaagcgagtccctggacgtctactgacgctgagacgcgaaagctaggggagcgaacggg

SEQ ID NO: 2314 - DNA, 254 bp, Unknown
  Description of Unknown: bacterium polynucleotide
  Planctomycetia; Isosphaeraceae
gacgaaccgtgcgaacgttattcggaatcactgggcttaaagcgcgtgtaggcggatggggacgtcggtcgctgaaatcccccggctcaaccggggaacgggcgccgaaacgccccgtctggaggaacgtagggggacctggaacttccggtggagcggtgaaatgcgttgagatcggaaggaacgcccgtggcgaaagcgaggtcctggaccctttctgacgctgagacgcgaaagccaggggagcgaacggg

SEQ ID NO: 2315 - DNA, 254 bp, Unknown
  Description of Unknown: bacterium polynucleotide
  Planctomycetia; Isosphaeraceae
gacgaaccgtgcgaacgttattcggaatcactgggcttaaagcgcgtgtaggcggggcggtgcgtcggccgttgaaatcccccggcccaaccggggaaggggcgccgatacgaccggcctggagcgacgtagggggaactggaacttccggtggagcggtgaaatgcgttgagatcggaaggaacgcccgtggcgaaagcgagttcctggacgtcggctgacgctgagacgcgaaagccaggggagcgaacggg

SEQ ID NO: 2316 - DNA, 254 bp, Unknown
  Description of Unknown: bacterium polynucleotide
  Planctomycetia; Isosphaeraceae
gacgaaccgtccgaacgttattcggaattactgggcttaaagcgcgtgtaggcggctgggcacgtccgacgctgaaagcccccggctcaaccggggaagtggcgcggatacggctcggctggaggggggtaggggggcctggaacttcgggtggagcggtgaaatgcgttgagatccgaaggaacgcccgtggcgaaagcgaggccctggaccctttctgacgctgagacgcgaaagccaggggagcgaacggg

SEQ ID NO: 2317 - DNA, 254 bp, Unknown
  Description of Unknown: bacterium polynucleotide
  Planctomycetia; Isosphaeraceae
gacgaaccgtgcgaacgttattcggaatcactgggcttaaagcgcgtgtaggcgggacggcacgtcggtcgctgaaatcccccggctcaaccggggaacgggcgccgatacgaccgccctggagggacgtagggggacctggaacttccggtggagcggtgaaatgcgttgagatcggaaggaacgcccgtggcgaaagcgaggtcctggacgttttctgacgctgagacgcgaaagccaggggagcaaacggg

SEQ ID NO: 2318 - DNA, 254 bp, Unknown
  Description of Unknown: bacterium polynucleotide
  Planctomycetia; Isosphaeraceae
gacgaaccgtgcgaacgttattcggaaccactgggcttaaagcgcgtgtaggcgggccggcacgtcggtcgctgaaatcccccggctcaaccggggaagcggcgccgatacgaccggcctggaggggcgtagggggaccgggaacttccggtggagcggtgaaatgcgttgagatcggaaggaacgcccgtggcgaaagcgcggtcctggacgcctgctgacgctgagacgcgaaagccaggggagcgaacggg

SEQ ID NO: 2319 - DNA, 253 bp, Unknown
  Description of Unknown: bacterium polynucleotide
  Planctomycetia; Isosphaeraceae
gacgaaccgtgcgaacgttattcggaatcactgggcttaaagcgcgtgtaggcggatgggaacgtcggtgctgaaagcccccggctcaaccggggaacgggcgccgaaacgacccgtctggaggggcgtagggggacccggaacttccggtggagcggtgaaatgcgttgagatcggaaggaacgcccgtggcgaaagcggggtcctggatgcctactgacgctgagacgcgaaagccaggggagcgaacggg

SEQ ID NO: 2320 - DNA, 254 bp, Unknown
  Description of Unknown: bacterium polynucleotide
  Planctomycetia; Isosphaeraceae
gacgaaccgtgcgaacgttattcggaatcactgggcttaaagcgcgtgtaggtgggacagcacgtcggtcgttgaaatcccccggctcaaccggggaaggggcgccgatacgatcgtcctggagggacgtagggggacctggaacttccggtggagcggtgaaatgcgttgagatcggaaggaacgcccgtggcgaaagcgaggtcctggacgttttctgacactgagacgcgaaagccaggggagcgaacggg

SEQ ID NO: 2321 - DNA, 254 bp, Unknown
  Description of Unknown: bacterium polynucleotide
  Planctomycetia; Isosphaeraceae
gacgaaccgtgcgaacgttattcggaatcattgggcttaaagggcgcgtaggcgggtcgacacgtcggaactgaaatcccccggctcaaccggggaacgggccccgatacgatcgacctcgaggtgaggagggggatccggaacgtccggtggagcggtgaaatgcgttgagatcggacggaacgccgatggcgaaagcaaggtcctggactcatatctgacgctgaggcgcgaaagccaggggagcaaacggg

SEQ ID NO: 2322 - DNA, 254 bp, Unknown
  Description of Unknown: bacterium polynucleotide
  Planctomycetia; Isosphaeraceae
gacgaaccgtgcgaacgttattcggaatcactgggcttaaagcgcgtgtaggcgggccggtacgtcgttcgctgaaagcccccggctcaaccgggggagtggcggcgatacgaccggcctggaggggggtagggggacctggaacttccggtggagcggtgaaatgcgttgagatcggaaggaacgcccgtggcgaatgcgaggtcctggaccctttctgacgctgagacgcgaaagccaggggagcgaacggg

SEQ ID NO: 2323 - DNA, 254 bp, Unknown
  Description of Unknown: bacterium polynucleotide
  Planctomycetia; Isosphaeraceae
gacgaaccttgctaacgttattcggaatcactgggcttaaagcgcgtgtaggtgggttgccacgtcggatgctgaaatccctcggctcaaccgaggaacgggcaccgatacgagcgacctggaggggggtagggggagctggaacttccggtggagcggtgaaatgcgttgagatcggaaggaacgcccgtggcgaaagcgagctcctggaccttttctgacactgagacgcgaaagctaggggagcgaacggg

SEQ ID NO: 2324 - DNA, 254 bp, Unknown
  Description of Unknown: bacterium polynucleotide
  Planctomycetia; Isosphaeraceae
gacgaaccgtgcgaacgttattcggaatcattgggcttaaagcgcgtgtaggcggattcgtgcgtctgtcgttgaaatcccccggctcaaccggggaagtggcgcggatacgacgagtctggaggggcatagggggacctggaacttccggtggagcggtgaaatgcgttgagatcggaaggaacgcccgtggcgaaagcgaggtcctggatgcctactgacgctgagacgcgaaagccaggggagcgaacggg

SEQ ID NO: 2325 - DNA, 254 bp, Unknown
  Description of Unknown: bacterium polynucleotide
  Planctomycetia; Isosphaeraceae
gacgaaccgtccgaacgttattcggaattactgggcttaaagcgcgtgtaggcggctgggtacgtctggtgttgaaatcccccggcttaaccggggaacgggcacagatacgaccgagctggagggaggtaggggggtctggaacttccggtggagcggtgaaatgcgttgagatcggaaggaacgcccgtggcgaaagcgaggccctggaccctttctgacgctgagacgcgaaagctaggggagcgaacggg

SEQ ID NO: 2326 - DNA, 253 bp, Unknown
  Description of Unknown: bacterium polynucleotide
  Planctomycetia; Pirellulaceae
cacgaaccgtacgaacgttattcggaattactgggcttaaagggtttgtaggcggccttgtaagtcaggtgtgaaagccctcggctcaaccgaggaacagcgcttgatactgcaaggcttgagggagacaggggtaagcggaactgatggtggagcggtgaaatgcgttgatatcatcaggaacaccggtggcgaaagcggcttactgggtctcttctgacgctgaggaacgaaagctagggtagcgaacggg

SEQ ID NO: 2327 - DNA, 253 bp, Unknown
  Description of Unknown: bacterium polynucleotide
  Planctomycetia; Pirellulaceae
gacgaaccgtccaaacgttattcggaattactgggcttaaagggtgcgtaggcggtgctacaagtcgggtgtgaaatccctcagcttaactgaggaactgcgcccgaaactgtagtgctggagtgaggcaggggtgagcggaactgatggtggagcggtgaaatgtgttgatatcatcaggaacaccggtggcgaaggcggctcactgggcctttactgacgctgaggcacgaaagctaggggagcgaacggg

SEQ ID NO: 2328 - DNA, 253 bp, Unknown
  Description of Unknown: bacterium polynucleotide
  Planctomycetia; Pirellulaceae
tacgaaccttgctaacgttattcggaattactgggcttaaagggtgcgtaggcggtgcagcaagtcgggtgtgaaagccctcagcttaactgaggaattgcgtccgaaactgctgtgcttgaggaatacagaggtatgcggaacttagggtggagcggtgaaatgcgttgatatcctaaggaacaccggtggcgaaagcggcatactgggtattttctgacgctcatgcacgcaagctagggtagcgaacggg

SEQ ID NO: 2329 - DNA, 253 bp, Unknown
  Description of Unknown: bacterium polynucleotide
  Planctomycetia; Pirellulaceae
cacgaaccgtacgaacgttattcggaattactgggcttaaagggtttgtaggcggccacgtaagtcaggtgtgaaatccctcggctcaaccgaggaatggcgcttgatactgcgtggcttgagggagacaggggtaagcggaactgatggtggagcggtgaaatgcgttgatatcatcaggaacaccggtggcgaaagcggcttactgggtctcttctgacgctgaggaacgaaagctagggtagcgagcggg

SEQ ID NO: 2330 - DNA, 253 bp, Unknown
  Description of Unknown: bacterium polynucleotide
  Planctomycetia; Pirellulaceae
cacgaaccgtccaaacgttattcggaattattgggcttaaagggtgcgtaggcggcgctttaagtcgggtgtgaaatccttcggctcaaccgaagaattgcgcccgatactggagtgctagagggagacaggggtgagcggaactgatggtggagcggtgaaatgcgttgatatcatcaggaacaccggtggcgaaagcggctcactgggtctcttctgacgctgaggcacgaaagccagggtagcgaacggg

SEQ ID NO: 2331 - DNA, 253 bp, Unknown
  Description of Unknown: bacterium polynucleotide
  Planctomycetia; Pirellulaceae
gacgaaccacccaaacgttattcggaattactgggcttaaagagtgcgtaggcggccttgaaagtagggtgtgaaatccctcggctcaaccgaggaactgcgctcaaaactaccgtgcttgagggagacagaggtgagcggaacttagggtggagcggtgaaatgcgttgatatcctaaggaacaccggtggcgaaggcggctcactgggtctcttctgacgctgaggcacgaaagctagggtagcgaacggg

SEQ ID NO: 2332 - DNA, 253 bp, Unknown
  Description of Unknown: bacterium polynucleotide
  Planctomycetia; Pirellulaceae
cacgaaccgggcaaacgttattcggaattactgggcttaaagggtgcgtaggctgcgctataagtcgggtgtgaaatccctcagctcaactgaggaactgcgcccgatactgtagtgcttgaggaggatagaggtgagcggaactagcagtggagcggtgaaatgcgttgatattgctgggaacacccgtggcgaaagcggctcactgggtcctttctgacgctgaggcacgaaagctaggggagcgaacggg

SEQ ID NO: 2333 - DNA, 253 bp, Unknown
  Description of Unknown: bacterium polynucleotide
  Planctomycetia; Pirellulaceae
gacgaactgcgcaaacgttattcggaattactgggcttaaagagtccgtaggcggcgtgttaggtggggtgtgaaatccctcggcccaaccgaggaattgcgctccaaaccggcacgctagaggaaggtagaggtgagcggaactgatggtggagcggtgaaatgcgttgatatcatcaggaacaccggaggcgaaggcggctcactgggccttttctgacgctgagggacgaaagctaggggagcgaacggg

SEQ ID NO: 2334 - DNA, 253 bp, Unknown
  Description of Unknown: bacterium polynucleotide
  Planctomycetia; Pirellulaceae
gacgaaccgtccgaacgttattcggaatcactgggcttaaagagtgcgtaggcggcttatcaggcggggtgtgaaatccctcggcccaaccgaggaattgcgctccgaaccgataggcttgaggaggatagaggtaagcggaacagatggtggagcggtgaaatgcgttgatatcatctggaacacctgtggcgaaagcggcttactgggtcctttctgacgctgaggcacgaaagccagggtagcgaacggg

SEQ ID NO: 2335 - DNA, 253 bp, Unknown
  Description of Unknown: bacterium polynucleotide
  Planctomycetia; Pirellulaceae
gacgaaccgtccgaacgttattcggaattattgggcttaaagggtgcgtaggcggccttgtaagtcgggtgtgaaatcccacggctcaaccgtggaactgcgcccgatactgcatggcttgagggagacagaggtaagcggaactgatggtggagcggtgaaatgcgttgatatcatcaggaacaccggtggcgaaagcggcttactgggtctcttctgacgctgaggcacgaaagctagggtagcgaacggg

SEQ ID NO: 2336 - DNA, 253 bp, Unknown
  Description of Unknown: bacterium polynucleotide
  Planctomycetia; Pirellulaceae
gacgaacctgacgaacgttattcggaattactgggcttaaagggtgcgtaggcggcgccacaagttgggtgtgaaatccctcggctcaaccgaggaactgcgcccaatactgtggtgctcgagggagacagaggtgagcggaacttagggtggagcggtgaaatgcgttgatatcctaaggaacaccggtagcgaaagcggctcactgggtcttttctgacgctgaggcacgaaagctagggtagcgaacggg

SEQ ID NO: 2337 - DNA, 253 bp, Unknown
  Description of Unknown: bacterium polynucleotide
  Planctomycetia; Pirellulaceae
gacgagcctcacgaacgttattcggaatcactgggcttaaagggtgcgtaggcggtgtggaaagtcggatgtgaaatacctcagcttaactgaggaactgcactcgatacttccatgctagagtaagacagaggtgagtggaactgagggtggagcggtgaaatgcgttgatatcctcaggaacaccggtggcgaaggcgactcactgggtctttactgacgctgatgcacgaaagctagggtagcaaacggg

SEQ ID NO: 2338 - DNA, 253 bp, Unknown
  Description of Unknown: bacterium polynucleotide
  Planctomycetia; Pirellulaceae
gacgaaccgtacaaacgttatttggaatcactgggcttaaagggtgcgtaggcggcgctgaaagttgggtgtgaaatccctcggctcaaccgaggaactgcgcccaaaactacagtgcttgagggagatagaggtgagcggaacttagggtggagcggtgaaatgcgttgatatcctaaggaacgccaggggcgaaagcggctcactgggtctcttctgacgctgaggcacgaaagctagggtagcgaacggg

SEQ ID NO: 2339 - DNA, 253 bp, Unknown
  Description of Unknown: bacterium polynucleotide
  Planctomycetia; Pirellulaceae
gacgagccacacgaacgttattcggaattactgggcttaaagggtgcgtaggctgcgcggcaagttgggtgtgaaatccctcggctcaaccgaggaactgcgcccaaaactgccgtgctcgaggaagatagaggtaagcggaacttacggtggagcggtgaaatgcgttgatatcgtaaggaacacctgtggcgaaagcggcttactgggtcttttctgacgctgatgcacgaaagctaggggagcaaacggg

SEQ ID NO: 2340 - DNA, 253 bp, Unknown
  Description of Unknown: bacterium polynucleotide
  Planctomycetia; Pirellulaceae
gacggaccacacaaacgttattcggaatcactgggcttaaagggtgcgcaggctgtgcagtaagtcgggtgtgaaatccctcggctcaaccgaggaactgcgcccgatactactgtgctcgagggagatagaggtgagcggaacttagggtggagcggtgaaatgcgttgatatcctaaggaacaccggtggcgaaagcggctcactggatctcttctgacgctcaggcacgaaagctaggggagcgaacggg

SEQ ID NO: 2341 - DNA, 253 bp, Unknown
  Description of Unknown: bacterium polynucleotide
  Planctomycetia; Pirellulaceae
gacgaaccatgcaaacgttattcggattcactgggcctaaagcgtgcgtaggcggcgatgttagtcaggtgtgaaagccctcagcccaactgaggaattgcgcttgatactgcatcgctagagaatgatagaggtgggtggaactgatggtggagcggtgaaatgcgttgatatcatcaggaacaccagtggcgaaggcgacccactgggtcatttctgacgctgaggtacgaaagctagggtagcgaacggg

SEQ ID NO: 2342 - DNA, 253 bp, Unknown
  Description of Unknown: bacterium polynucleotide
  Planctomycetia; Pirellulaceae
tacgaacggtccaaacgttattcggaatcactgggcttaaagcgtccgtaggcggctcggaaagtagggtgtgaaatcccacggctcaaccgtggaattgcgctctaaactatcgagctagagggagatagaggtgagcggaactgatggtggagcggtgaaatgcgttgatatcatcaggaacaccggaggcgaaggcggctcactgggtcttttctgacgctgagggacgaaagctaggggagcgaacggg

SEQ ID NO: 2343 - DNA, 253 bp, Unknown
  Description of Unknown: bacterium polynucleotide
  Planctomycetia; Pirellulaceae
gacgaaccgtccgaacgttattcggaatcactgggcttaaagagtgcgtaggcggcttgccaggcggggtgtgaaatccttcggcccaaccgaagaattgcgctccgaaccggcaggctcgaggtggataggggcaagcggaacagatggtggagcggtgaaatgcgttgatatcatctggaacacctgtggcgtaagcggcttgctgggtccattctgacgctgaggcacgaaagccagggtagcgaacggg

SEQ ID NO: 2344 - DNA, 253 bp, Unknown
  Description of Unknown: bacterium polynucleotide
  Planctomycetia; Pirellulaceae; A17
gacgagcctcacgaacgttattcggaattactgggcttaaagggtgcgtaggcggcgcggaaagtagggtgtgaaatccctcggctcaaccgaggaactgcgctctaaactaccgtgctcgagggagatagaggtaagcggaacttagggtggagcgatgaaatgcgttgatatcctaaggaacaccggtggcgaaagcggcttactggatctcttctgacgctgaggcacgaaagctagggtagcgaacggg

SEQ ID NO: 2345 - DNA, 253 bp, Unknown
  Description of Unknown: bacterium polynucleotide
  Planctomycetia; Pirellulaceae; A17
gacgaaccgtacgaacgttattcggaatcactgggcttaaagggtgcgtaggcggcgatgaatgttgggtgtgaaatccctcggctcaaccgaggaactgcgcccaaaactacattgcttgagggagatagaggcgagcggaacttagggtggagcggtgaaatgcgttgatatcccaaggaacgccaggggcgaaagcggctcactggatctcttctgacgctgaggcacgaaagctagggtagcgaacggg

SEQ ID NO: 2346 - DNA, 253 bp, Unknown
  Description of Unknown: bacterium polynucleotide
  Planctomycetia; Pirellulaceae; A17
gacgaaccgtacgaacgttattcggaatcactgggcttaaagggtgcgtaggcggcgataaaagttgggtgtgaaatccctcggctcaaccgaggaactgcgcccaaaactgtattgctcgagggagatagaggtgagcggaacttagggtggagcggtgaaatgtgttgatatcctaaggaacgccaggggcgaaagcggctcactggatctcttctgacgctgaggcacgaaagctagggtagcgaacggg

SEQ ID NO: 2347 - DNA, 253 bp, Unknown
  Description of Unknown: bacterium polynucleotide
  Planctomycetia; Pirellulaceae; A17
gacgagcctcacaaacgttattcggaattactgggcttaaagggtgcgtaggcggcgcggaaagttgggtgtgaaatccctcggctcaaccgaggaacagcgctcaaaactaccgtgctcgagggagatagaggaatgcggaactttcggtggagcggtgaaatgcgttgatatcgtagggaacaccggtggcgaaagcggcattctggatctcttctgacgctgatgcacgaaagctagggtagcaaacggg

SEQ ID NO: 2348 - DNA, 253 bp, Unknown
  Description of Unknown: bacterium polynucleotide
  Planctomycetia; Pirellulaceae; A17
gacgaaccgtacgaacgttattcggaattactgggcttaaagggtgcgtaggcggcgcagtaagttgggtgtgaaatccctcggcttaaccgaggaattgcgcccaaaactactgtgctcgagggagatagaggtgagcggaacttagggtggagcggtgaaatgcgttgatatcctaaggaacaccggtggcgaaagcggctcactggatctcttctgacgctgaggcacgaaagctagggtagcaaacggg

SEQ ID NO: 2349 - DNA, 253 bp, Pirellula sp.
  Planctomycetia; Pirellulaceae; Pirellula
tacgagaggcccaaacgttattcggatttactgggcttaaagagttcgtaggcggttcggtaagtgaggtgtgaaagccctcggctcaaccgaggtattgcgcttcaaactgccgggctcgagggagatagaggtgagcggaactgatggtggagcggtgaaatgcgttgatatcatcaggaacaccagaggcgaaggcggctcactgggtctctactgacgctgaggaacgaaagccaggggagcaaacggg

SEQ ID NO: 2350 - DNA, 253 bp, Pirellula sp.
  Planctomycetia; Pirellulaceae; Pirellula
tacgagaggcccaaacgttattcggaattactgggcttaaagagttcgtaggcggtattgcaagtagggtgtgaaagccctcggctcaaccgaggaattgcgctctaaactgcagtacttgaggaacctagaggtgagcagaacagatggtggagcggtgaaatgcgttgatatcatctggaataccggaggcgaaggcggctcactgggagttttctgacgctgaggaacgaaagccagggtagcgaacggg

SEQ ID NO: 2351 - DNA, 253 bp, Pirellula sp.
  Planctomycetia; Pirellulaceae; Pirellula
tacgaaccgtccaaacgttattcggaatcactgggcttacagagttcgtaggcggcggagaaagtagggtgtgaaagccctcggctcaaccgaggaattgcgccctaaactacttcgcttgaggaggctagaggtgagcagaacagatggtggagcggtgaaatgcgttgatatcatctggaataccggaggcgaaggcggctcactgggacctttctgacgctgaggaacgaaagctagggtagcgaacggg

SEQ ID NO: 2352 - DNA, 253 bp, Planctomyces sp.
  Planctomycetia; Planctomycetaceae; Planctomyces
tacgaactgtgcaaacgttattcggaatcactgggcttaaagggtgcgtaggcggtttgttaagtagggtgtgaaagcccccggctcaaccggggaattgcgccctaaactggcggactagagtgagataggggtgtgcggaacttccggtggagcggtgaaatgtgttgatatcggaaggaacgccggtggcgaaagcggcacactgggtctcaactgacgctgaggcacgaaagccaggggagcaaacggg

SEQ ID NO: 2353 - DNA, 253 bp, Planctomyces sp.
  Planctomycetia; Planctomycetaceae; Planctomyces
tacgaactgtgcaaacgttattcggaatcactgggcttacagggtgcgtaggtggccggacaagtcaggtgtgaaatccctcagctcaactgaggaactgcgcttgaaactgtttggctagagtgagctaggggtacttggaactgccagtggagcggtgaaatgtgttgatattggcaggaacaccggagccgaaagggaagtactggggcttaactgacactgaggcacgaaagccaggggagcaaacggg

SEQ ID NO: 2354 - DNA, 253 bp, Planctomyces sp.
  Planctomycetia; Planctomycetaceae; Planctomyces
gacgaactgtgcaaacgttattcggaatcactgggcttgaagagtgcgtaggcggtttcgtaagtagggtgtgaaagtcctcggctcaaccgggggattgcgccctaaactgcgaggctggagtgaggtaggggtgtgtggaacttctagtggagcggtgaaatgtgttgatattagaaggaacgccggtggcgaaagcgacacactggaccttgtctgacgctgaggcacgaaagccaggggagcaaacggg

SEQ ID NO: 2355 - DNA, 253 bp, Planctomyces sp.
  Planctomycetia; Planctomycetaceae; Planctomyces
tacgtactgtgcgaacgttattcggaatcactgggcttaaagggtgtgtaggcggccagataagtagggtgtgaaaggctccggctcaaccggggcactgcgctctagactgtctggctcgagcaagataggggtgtgcggaacttccagtggagcggtgaaatgtgttgatattggaaggaacgccggtggcgaaagcggcacactgggtcttgtctgacgctgagacacgaaagccaggggagcgaacggg

SEQ ID NO: 2356 - DNA, 252 bp, Planctomyces sp.
  Planctomycetia; Planctomycetaceae; Planctomyces
tacggagggtgcaagcgttatccggattcactgggcttaaagggtgcgtaggcggttatctaagtcacgtgtgaaatcttctggctcaaccagaaaactgcgcgtgatactggaaaacttgagtgaggtaggggtgtgtggaacttccggtggagcggtgaatgtgtagagatcggaaggaacgccagcagcgaaagcggcacactgggccttttctgacgctgaggcacgaaagctaggggagtgaacggg

SEQ ID NO: 2357 - DNA, 253 bp, Planctomyces sp.
  Planctomycetia; Planctomycetaceae; Planctomyces
tacgaactgtgcaaacgttattcggaatcactgggcttaaagggtgcgtaggcggctgtctaagtagggtgtgaaagcccccggctcaaccggggaattgcgccctaaactggatggctggagtgaggcaggggtgtgtggaacttccggtggagcggtgaaatgtgttgatatcggaaggaacgccggtggcgaaagcgacacactgggtctcaactgacgctgaggcacgaaagccaggggagcaaacggg

SEQ ID NO: 2358 - DNA, 253 bp, Planctomyces sp.
  Planctomycetia; Planctomycetaceae; Planctomyces
gacgaactgtgcaaacgttattcggaatcactgggcttaaagggtgcgtaggcggtcttgtaagtagggtgtgaaagcccccggctcaaccggggaactgcgtcctaaactgcgaggcttgagtgaggtaggggtgtgtggaacttccagtggagcggtgaaatgtgttgatattggaaggaacgccggtggcgaaagcgacacactggaccttgtctgacgctgaggcacgaaagccaggggagcaaacggg

SEQ ID NO: 2359 - DNA, 253 bp, Planctomyces sp.
  Planctomycetia; Planctomycetaceae; Planctomyces
tacgaactgtgcgaacgttattcggaatcactgggcttacagggtgcgtaggcggcttgtcaagtagggtgtgaaagcccccggctcaaccggggaatggcgccctaaactggcgagctagagtgagataggggtgtgtggaacttccggtggagcggtgaaatgtgttgatatcggaaggaacgccggtggcgaaagcgacacactggatcttgtctgacgctgaggcacgaaagccaggggagcgaacggg

SEQ ID NO: 2360 - DNA, 253 bp, Planctomyces sp.
  Planctomycetia; Planctomycetaceae; Planctomyces
gacgaactgtgcaaacgttattcggaatcactgggcttgaagagtgcgtaggcggttttgtaagtagggtgtgaaagcccccggctcaaccggggaattgcgccctagactgcaaggctggagtgaggtaggggtgtgtggaacttccagtggagcggtgaagtgtgttgatattggaaggaacgccggtggcgaaagcgacacactggaccttgtctgacgctgaggcacgaaagccaggggagcaaacggg

SEQ ID NO: 2361 - DNA, 253 bp, Planctomyces sp.
  Planctomycetia; Planctomycetaceae; Planctomyces
gacgaaccgtgcgaacgttattcggaatcactgggcttacagggtgcgtaggcggcgatgcaagtcaggtgtgaaagcccacggctcaaccgtggaactgcgcttgaaactgcattgctggagtgagctagaggtatgcggaacttccggtggagcggtgaaatgtgttgatatcggaaggaacaccagaggcgaaagcggcatactggagcttgtctgacgctgaggcacgaaagccaggggagcaaacggg

SEQ ID NO: 2362 - DNA, 253 bp, Unknown
  Description of Unknown: bacterium polynucleotide
  PRR-12
tacggggggagcaagcgttgttcggaatcactgggcgtaaagggagtgtaggcggttcggtaagtgggatgtgaaatgccccggctcacccggggacctgcatcccaaactgctgagcttgagtacaggagagggtgggggaattccaggtgtagcggtgaaatgcgtagatatctggaggaacaccggtggcgaaggcgcccacctggcctgctactgacgctgaggctcgaaagctaggggagcaaacggg

SEQ ID NO: 2363 - DNA, 253 bp, Unknown
  Description of Unknown: bacterium polynucleotide
  PRR-12
tacggggggagcgaacgttgttcggaatcactgggcgtaaagggcgtgtaggcggctgaataagtgggatgttaaatcccccggctcaaccggggacctgcatctcatactgttcagctcgagcacatcagaggagactggaattcccggtgtagcggtgaaatgcgtagatatcgggaggaacaccagtggcgaaggcgagtctctgggatgatgctgacgctgagtcgcgaaagccaggggagcaaacggg

SEQ ID NO: 2364 - DNA, 253 bp, Unknown
  Description of Unknown: bacterium polynucleotide
  RF3
tacatagggggcaagcgttatccggaattattgggcgtaaagcgtgcgtaggcggtttattaagtctgatgtgaaatgtcacagcttaactgtgaagggtcattggaaactggtaaacttgagtacagtaggggtaagcggaattccatgtgtagcggtgaaatgcgtagagatatggaggaacaccagtggcgaaggcggctctctggtctgcaactgacgctgaggcacgaaagcgtggggagcaaacagg

SEQ ID NO: 2365 - DNA, 253 bp, Unknown
  Description of Unknown: bacterium polynucleotide
  RF3
tacatagggggcgagcgttatccggaattactgggcgtaaagggtgcgtaggcggtttcttaagtctagtgtgaaagcccacggcttaaccgtggagggtcattagaaactgggagacttgagtacagcagaggtaagtggaatttctagtggagcggtgaaatgcgtagatattagaaggaacaccagtggcgaaggcggcttactgggctggaactgacgctgaggcacgaaagcgtggggagcaaacagg

SEQ ID NO: 2366 - DNA, 253 bp, Rubrobacter sp.
  Rubrobacteria; Rubrobacteraceae; Rubrobacter
tacgtagggggcgagcgttgtccggaatcattgggcgtaaagagcgtgtaggcggcccggtaagtccgctgtgaaaacccggggctcaaccccgggcgtgcagtggaaactgccgggctagagggcggcagaggcgagtggaattcccggtgtagcggtgaaatgcgcagatatcgggaggaacaccagtagcgaaggcggctcgctgggccgttcctgacgctgagacgcgaaagctaggggagcgaacagg

SEQ ID NO: 2367 - DNA, 253 bp, Rubrobacter sp.
  Rubrobacteria; Rubrobacteraceae; Rubrobacter
tacgtagggggcgagcgttgtccggaattattgggcgtaaagagcgtgtaggctgttcggtaagtctgccgtgaaaacctgaggctcaacctcgggcgtgcggtggatactgccgggctagaggacggtagaggcgagtggaattcccggtgtagcggtgaaatgcgcagatatcgggaggaacaccagtagcgaaggcggctcgctgggccgttcctgacgctgagacgcgaaagctaggggagcgaacagg

SEQ ID NO: 2368 - DNA, 253 bp, Rubrobacter sp.
  Rubrobacteria; Rubrobacteraceae; Rubrobacter
tacgtagggggcgagcgttgtccggaattattgggcgtaaagagcgtgtaggcggttcggtaagtctgtcgtgaaatcctggggctcaaccccgggcgtgcgatggatactgccgggctagagggtggtagaggcgagtggaattcccgatgtagcggtgaaatgcgcagatatcgggaggaacaccagtagcgaaggcggctcgctgggccacacctgacgctgagacgcgaaagctaggggagcgaacagg

SEQ ID NO: 2369 - DNA, 253 bp, Rubrobacter sp.
  Rubrobacteria; Rubrobacteraceae; Rubrobacter
tacgtagggggcgagcgttgtccggatttattgggcgtaaagagcgtgtaggcggtccggtaagtctgtcgtgaaatcctgaggctcaacctcgggcgtgcgatggatactgccgggctagaggatggtagaggcgagtggaattcccggtgtagcggtgaaatgcgcagatatcgggaggaacaccagtcgcgaaggcggctcgctgggccattcctgacgctgagacgcgaaagctaggggagcgaacagg

SEQ ID NO: 2370 - DNA, 253 bp, Rubrobacter sp.
  Rubrobacteria; Rubrobacteraceae; Rubrobacter
tacgtagggggcgagcgttgtccggaatcattgggcgtaaagagcgtgtaggcggttcggtaagtccgccgtgaaaacctggggctcaaccccgggcgcgcggtggatactgccgggctagaggatggtagaggcgagtggaattcccggtgtagcggtgaaatgcgcagatatcgggaggaacaccagtagcgaaggcggctcgctgggccattcctgacgctgagacgcgaaagctaggggagcgaacagg

SEQ ID NO: 2371 - DNA, 253 bp, Rubrobacter sp.
  Rubrobacteria; Rubrobacteraceae; Rubrobacter
tacgtagggggcgagcgttgtccggaattattgggcgtaaagagcgtgtaggcggttcggtaagtctgccgtgaaaacccagggctcaaccctgggcgtgcggtggatactgccgggctagagggtggtagaggcgagtggaattcccggtgtagcggtgaaatgcgcagatatcgggaggaacaccagtagcgaaggcggctcgctgggccacacctgacgctgagacgcgaaagcgtggggagcaaacagg

SEQ ID NO: 2372 - DNA, 253 bp, Unknown
  Description of Unknown: bacterium polynucleotide
  S035
tacggagggagcaagcgttactcggaattactgggcgtaaagggcgcgtaggcgattttgtaagtcttgtgtgaaagcccaaagcctaactttggaagtgcacgagaaactgtgaaatttgagttccggagaggaagatggaattcccggtgtagcggtgaaatgcgtagatatcgggaggaacaccagtggcgaaggcgatcttctggacggatactgacgctgaggcgcgaaagctaggggagcaaacggg

SEQ ID NO: 2373 - DNA, 253 bp, Unknown
  Description of Unknown: bacterium polynucleotide
  S085
tacgtaggtggcaagcgttgtccggatttactgggcgtaaagggcgtgcaggcggtttgttaagtctagggtgaaagctcccggctcaactgggagaggtccttggataccggcagacttgaggagagtagaggaaagtggaattcccggtgtagtggtgatatgcgtagatatcgggaggaacaccagtggcgaaggcggctttctgggctctacctgacgctgaggcgcgaaagcgtggggagcaaacagg

SEQ ID NO: 2374 - DNA, 253 bp, Unknown
  Description of Unknown: bacterium polynucleotide
  S085
tacgtaggtggcaagcgttgtccggatttattgggcgtaaagggcgcgcaggcggttcgttaggtccgaggtgaaatctcccggctcaactgggaggggtcttcggataccggcgggcttgaggtgagcagaggtgagcggaattctgggagtagtggtgaaatgcgtagatatccagaggaacaccagtggcgaaggcggctcactgggctccacctgacgctgaggcgcgaaagcgtggggagcgaaccgg

SEQ ID NO: 2375 - DNA, 253 bp, Unknown
  Description of Unknown: bacterium polynucleotide
  SBRH58
tacgaagggtgcgagcgttattcggaatgactgggtgtaaagagcgtggaggcggtttgttaagtttgttgttaaatcgcccggcttaaccgggcacatgcgatgaaaactggcaagctagagtgcgggagagaaaggtagaattctcggagtagcggtaaaatgcgtagatctcgagaggaataccggttgcgaaggcggccttttggcccgttactgacgctggagcgcgaaagcgtggggagcaaacagg

SEQ ID NO: 2376 - DNA, 253 bp, Unknown
  Description of Unknown: bacterium polynucleotide
  SBRH58
tacggggggagcaagcgttgttcggatttactgggcgtaaagggcgtgtaggcggttgattaagtcagttgttaaattcctcagcctaactgaggccaagcaattgaaactggtcggctagagtacagaagagagaagtggaattatcggagtagcggtaaaatgcgtagatctcgataggaacaccaatggcgaaggcagcttcttggtctgttactgacgctaaaatgcgaaagcgtggggagcaaacagg

SEQ ID NO: 2377 - DNA, 254 bp, Unknown
  Description of Unknown: bacterium polynucleotide
  SC3
tacgtagggtccaagcgttatccggaatcactgggcgtaaagagtgcgtaggcgggtttttaagtgcaatgcgaaatcctggggctcaaccccatggactgtattgcatactggataccttgaggaatgcagaggcaagtggaattaccggtgtagcagtgaaatgcgtagagatcggtaggaacaccaatggcgaaggcagcttgctgggcattatctgacgctaaggcacgaaagcgtggggagcgaacagg

SEQ ID NO: 2378 - DNA, 253 bp, Unknown
  Description of Unknown: bacterium polynucleotide
  SC3
tacgtagggtccaagcgttatccggaatcactgggcgtaaagcgtgcgtaggtggcgtgttaagtgagatgttaaagcgcggggctcaaccctgtcgatgcatctcatactggcatgctagaggacagcagaggcaagtggaattagcagtgtagcagtgaaatgcgtagagattgctaggaacaccaatggcgaaggcagcttgctgggctactcctgacactgaggtacgaaagcgtggggagcgaacagg

SEQ ID NO: 2379 - DNA, 253 bp, Unknown
  Description of Unknown: bacterium polynucleotide
  SHA-109
tacgtaagtggcgagcgttatccggaatcactgggcgtaaagcgttcgtaggcggcgtggtaagtcggatttgaaatcccggagctcaactccggaactggatccgaaactaccatgcttgagcgtgtcagaggatagcggaattcccggtgtagcggtaatatgcgtagatattcggaggaacaccagtggcgaaggcggcttactggtccattactgacgctgaggtgcgaaagcgtggggagcaaacagg

SEQ ID NO: 2380 - DNA, 253 bp, Unknown
  Description of Unknown: bacterium polynucleotide
  SJA-28
tacgtagggggcaaacgttgtccggatttactgggtgtaaagggtgctcaggcggttttgtaagtcagaagtgaaatcctagagcttaactctggaactgcttttgatactgcaaggcttgaatgtggaagaggaggatggaatttctggtgtagcagtgaaatgcgtagatatcagaaagaacaccagtggcgaaggcggtcccctggtccactattgacgctaaagcacgaaagcgtggggagcaaacagg

SEQ ID NO: 2381 - DNA, 253 bp, Unknown
  Description of Unknown: bacterium polynucleotide
  SJA-4
tacgaggggtgcaagcgttatccggaattattgggcgtacagggcgcgtaggcggcttattaagtcttttgttaaatatcccggcctaaccgggaaacagcaacagatactggtgagcttgagggtggaagagagaagcggaattctcggagtagcggtaaaatgcgtagatctcgagaggaacaccgatggcgaaggcagcttcttggtccatacctgacgctgaggcgcgaaagcgtggggagcaaacagg

SEQ ID NO: 2382 - DNA, 253 bp, Unknown
  Description of Unknown: bacterium polynucleotide
  SJA-4
tacgaggggtgcaagcgttattcggaatcattgggcgtaaagggtgcgtagacggcttattaagtcagctgttaaatcttccggcctaaccggaaatctgcagtagatactggtatgctagagggtggaagagagaagtggaattctcggagtagcggtaaaatgcgtagatctcgaggggaacaccaatggcgaaggcagcttcttggtccacatctgacgttgaggcacgaaagcgtggggagcaaacagg

SEQ ID NO: 2383 - DNA, 253 bp, Unknown
  Description of Unknown: bacterium polynucleotide
  SJA-4
tacgaggggtgcaagcgttattcggaattattgggcgtacagggcgcgtagacggcatgttaagtcaactgttaaattccccggcctaaccgggggccagcagtagatactgatgtgctagaggatggaagagagaagtggaattctcggagtagcggtaaaatgcgtagatctcgagaggaacaccgatggcgaaggcagcttcttggtccatacctgacgttgaggcgcgaaagcgtggggagcaaacagg

SEQ ID NO: 2384 - DNA, 253 bp, Unknown
  Description of Unknown: bacterium polynucleotide
  SJA-4
tacgaggggtgcaaacgttattcggattgattgggcgtaaagggtgcgtaggcggcatgctaagtcaactgttaaatttcccggcctaaccgggatcctgcggtagatactggcaagcttgaggatggaagagagaagcggaattctcggagtagcggtaaaatgcgtagatctcgagaggaacaccaatggcgaaggcagcttcttggtccatatctgacgctgaggcacgaaagcgcggggagcaaacagg

SEQ ID NO: 2385 - DNA, 253 bp, Unknown
  Description of Unknown: bacterium polynucleotide
  SJA-4
tacgaggggtgcaagcgttattcggagtgattgggtgtaaagggtgcgtaggcggtatgtttagtcaattgttaaatttctcagcttaactgggagtcggcagttgatactggcgtgctagagggtggaagagagaggtggaattctcggagtagcggtaaaatgcgtagatctcgagaggaacaccaatggcgagggcagctttttggtccattcctgacgctgaggcacgaaagcatggggagcaaacagg

SEQ ID NO: 2386 - DNA, 253 bp, Unknown
  Description of Unknown: bacterium polynucleotide
  SJA-4
tacgagtggtgcaagcgttattcggaattattgggcgtaaagggtgtgtagacggcatgttaagtcaattgttaaattctccggcctaaccggaggccagcagtagaaactgacgtgctagagggtggaagagagaagcggaattctcggagtagcggtaaaatgcgtagatctcgagaggaacaccaatggcgaaggcagcttcttggtccatttctgacgttgaaacacgaaagcgtggggagcaaacagg

SEQ ID NO: 2387 - DNA, 253 bp, Unknown
  Description of Unknown: bacterium polynucleotide
  SJA-4
gacgaggggtgcgaacgttattcggaatgattgggcgtaaagggtgcgtaggcggtttatcaagtcaactgttaaatttctcagcttaactgggagtatgcggtagaaactgacaaactagaggatggaagagagaagtagaattctcggagtagcggtaaaatgcgtagatctcgagaggaacaccgatggcgaaggcagcttcttggtccatttctgacgctgaggcacgaaagcgtggggagcaaacagg

SEQ ID NO: 2388 - DNA, 253 bp, Unknown
  Description of Unknown: bacterium polynucleotide
  SJA-4
tacgaagggtgcaagcgttattcggaatcactgggcgtaaagggtgtgtagacggtacattaagttcgttgttaaaggctccggcccaactggagtattgcgatgaaaactggtgagctagagggtgagagagagaagtggaattcccggagtagcggtaaaatgcgtggatctcgggaggaacaccaatggcgaaggcagcttcttggctcattcctgacgttgaggcacgaaagcgtggggagcaaacagg

SEQ ID NO: 2389 - DNA, 253 bp, Unknown
  Description of Unknown: bacterium polynucleotide
  SJA-4
tacgaagggtgcaagcgttattcgggatcattgggcgtaaagggtgcgtagacggtatgttaagtctattgttaaatcttctggcctaaccagaaatctgcagtagatactgatgtgctagagggtggaagagagaagtggaattctcggagtagcggtaaaatgcgttgatctcgagaggaacaccaatggcgaaggcagcttcttggtccattcctgacgttgaggcacgaaagcgtggggagcaaacagg

SEQ ID NO: 2390 - DNA, 253 bp, Unknown
  Description of Unknown: bacterium polynucleotide
  SJA-4
tacgaagggtgcaagcgttattcggaatcactgggcgtaaagagtgcgtaggcggtatgctaagtttgtcgttaaagactctagcctaactggagggttgcgatgaaaactggtgcactagaggatgagagagagaagtggaattcctggagtagcggtaaaatgcgtggatctcaggaggaacaccaatggcgaaggcagcttcttggctcatatctgacgctgaggcacgaaagcgtggggagcaaacagg

SEQ ID NO: 2391 - DNA, 253 bp, Unknown
  Description of Unknown: bacterium polynucleotide
  SJA-4
gacgaggggtgcaaacgttattcggaatgattgggcgtaaagggtgcgtaggcggcttattaagtcaactgttaaatttctcagcttaactgggagtgtgcggtagaaactggtaggcttgagggtggaagagagaagtggaattctcggagtagcggtaaaatgcgtagatctcgagaggaacaccgatggcgaaggcagcttcttggtccatttctgacgctgaggcacgaaagcgtggggagcaaacagg

SEQ ID NO: 2392 - DNA, 253 bp, Unknown
  Description of Unknown: bacterium polynucleotide
  SJA-4
tacgaagggtgcgagcgttattcggaatcactgggcgtaaagggtgcgtagacggtatgttaagtttgtcgttaaagactctagcctaactggagggttgcgatgaaaactggcaagctagagggtgagagagagaagtggaattcctggagtagcgggaaaatgcgtggatctcaggaggaacaccaatggcgaaggcagcttcttggctcattcctgacgttgaggcacgaaagcgtggggagcgaacagg

SEQ ID NO: 2393 - DNA, 253 bp, Unknown
  Description of Unknown: bacterium polynucleotide
  SJA-4
tacgaagggtgcaagcgttattcggaatgattgggcgtaaagggtgcgcaggcggtatattaagtcaactgttaaatctcctggcttaaccaggaacaagcagcggatactgatgtgctagaggatgggagagagaagtggaattctcggagtagcggtaaaatgcgtagatctcgagaggaacaccgatggcgaaggcagcttcttggcccatttctgacgctcatgcacgaaagcgtggggagcaaacagg

SEQ ID NO: 2394 - DNA, 253 bp, Unknown
  Description of Unknown: bacterium polynucleotide
  SJA-4
tacggagggtgcaagcgttaatcggaatcattgggcgtaaagggtgcgtaggcggcatattaagtcagttgttaaaggctctggcctaaccggagtattgcaatgaaaactggcgtgctggagggtgagagagagaagtggaattcctggagtagcggtaaaatgcgtggatctcaggaggaacaccaatggcgaaggcagcttcttggctcattcctgacgttgaggcacgaaagcgtggggagcaaacagg

SEQ ID NO: 2395 - DNA, 253 bp, Unknown
  Description of Unknown: bacterium polynucleotide
  SJA-4
tacgagaggtgcaagcgttattcggaataattgggcgtaaagggtgcgtagacggtccgctaagtctgttgttaaatctttcggcttaaccgaaaatctgcaatggaaactggtaggctagagtgtgagagagagaagtggaattcttggagtagcggtaaaatgcgtagatctcaagaggaacaccgatggcgaaggcagcttcttggctcactactgacgttgaggcacgaaagcgtggggagcaaacagg

SEQ ID NO: 2396 - DNA, 253 bp, Unknown
  Description of Unknown: bacterium polynucleotide
  SJA-4
tacgagtggtgcaagcgttattcggaatcattgggcgtaaagggtgtgtagacggcatatcaagtcaactgtttaattctccggcctaaccggaggccagcggtagaaactgatgtgcttgaggatggaagagagaagtggaattctcggagtagcggtaaaatgcgtagatctcgagaggaacaccaatggcgaaggcagcttcttggtccatatctgacgttgaggcgcgaaagcgtggggagcaaacagg

SEQ ID NO: 2397 - DNA, 253 bp, Unknown
  Description of Unknown: bacterium polynucleotide
  SJA-4
tacgaggggtgcaagcgttatccggaattattgggcgtaaagggcgcgtaggttgcttattaagtccgttgttaaatctcccggcctaaccgggaatctgctatggatactgatgagctagaggatggaagagagaggtggaattctcggagtagcggtaaaatgcgtagatctcgagaggaacaccgatggcgaaggcagcctcttggtccattcctgacactgatgcgcgaaagcgtggggagcaaacagg

SEQ ID NO: 2398 - DNA, 253 bp, Unknown
  Description of Unknown: bacterium polynucleotide
  SJA-4
tacgagtggtgcaagcgttattcggaatcactgggcgtaaagggtgtgtaggcggcaagtcaagtctattgttaaatatcccggcttaaccgggaaggtgcgatggatactgatttgatagaggatggaagagagaagtggaattctcggagtagcggtaaaatgcgtagatatcgagaggaacaccgatggcgaaggcagcttcttggtccattcctgacgctgatacacgaaagcgtggggagcaaacagg

SEQ ID NO: 2399 - DNA, 253 bp, Unknown
  Description of Unknown: bacterium polynucleotide
  SJA-4
tacgagtggtgctagcgttattcggatttattgggcgtaaagggtgcgtagacggtatgataagtctgttgttaaatgcctcggctcaactgaggatctgcggtggaaactgtcatgctagaggatggaagagagaagtggaattcttggagtagcggtaaaatgcgtagatctcaagaggaacaccgatggcgaaggcagcttcttggtccattcctgacgttgaggcacgaaagcgtggggagcaaacagg

SEQ ID NO: 2400 - DNA, 253 bp, Unknown
  Description of Unknown: bacterium polynucleotide
  SJA-4
tacgagtggtgcaagcgttattcggaatcactgggcgtaaagggtgtgtaggcgacatttcaagtccattgttaaatatcccagcttaactgggaaggtgcaatggaaactgatctgttagagggtggaagagagaagtggaattctcggagtagcggtaaaatgcgtagatatcgagaggaacaccgatggcgaaggcagcttcttagtccatacctgacgctgatacacgaaagcgtggggagcaaacagg

SEQ ID NO: 2401 - DNA, 253 bp, Unknown
  Description of Unknown: bacterium polynucleotide
  SJA-4
gacgaagggtgcaagcgttattcggaattattgggcgtaaagggtgcgtagacggcatattaagtcaactgttaaatcctccggcctaaccggagatctgcggtagatactgatgtgctagagggtggaagagagaagtggaattctcggagtagcggtaaaatgcgtagatctcgagaggaacaccaatggcgaaggcagcttcttggtccatttctgacgttgaggcacgaaagcgtggggagcaaacagg

SEQ ID NO: 2402 - DNA, 254 bp, Unknown
  Description of Unknown: bacterium polynucleotide
  SJA-4
tacgagtggtgctagcgttattcggatttattgggcgtaaagggtgtgtagacggttttttaagtcacttgtttaatccttcggcctaaccgaagtacagcgagtgaaactgataaacttgagggtggaagagagaagtggaattctcggagtagcggtaaaatgcgtagatctcgagaggaacaccaatggcgaaggcagcttcttggtccatttcctgacgttgaaacacgaaagcgtggggagcaaacagg

SEQ ID NO: 2403 - DNA, 253 bp, Unknown
  Description of Unknown: bacterium polynucleotide
  SJA-4
tacgaggggtgcaagcgttattcggatttattgggcgtaaagggtgcgtaagtggtatgttaagtctgttgttaaattttccggcctaaccggaagcctgcaatggaaactggcgtacttgaggatggaagagggaagtggaattctcggagtagcggtaaaatgcgtggatctcgagaggaacaccgatggcgaaggcagcttcctggtccatatctgacactgaggcacgaaagcgtggggagcaaacagg

SEQ ID NO: 2404 - DNA, 253 bp, Unknown
  Description of Unknown: bacterium polynucleotide
  SJA-4
tacgaagggtgcaagcgttattcggatttattgggcgtaaagggtgcgcaggcggtgtgctaagtcaactgttaaatttcccagcctaactgggagcaaacagtagatactggcatgctagagggtggaagagagaagtggaattctcggagtagcggtaaaatgcgtagatctcgagaggaacaccgatggcgaaggcagcttcttggtccacacctgacgctcatgcacgaaagcgtggggagcaaacagg

SEQ ID NO: 2405 - DNA, 254 bp, Unknown
  Description of Unknown: bacterium polynucleotide
  SJA-4
tacgaggggtgcgagcgttattcggaatcattgggcgtaaagggtgcgtaggcggcaaattaagtcagctgttaaatttcctggcctaaccaggaacatgcggtcgatactgatgtgctagaggatggaagagagaagtggaattctcggagtagcggtaaaatgcgtagatctcgagaggaacaccgatggcgaaggcagcttcttggtccatatctgacgctgagtgcacgaaagcgtggggagcaaacagg

SEQ ID NO: 2406 - DNA, 253 bp, Unknown
  Description of Unknown: bacterium polynucleotide
  SJA-4
tacgaggggtgcaaacgttattcggatttactgggtgtaaagggtgtgtagacggtttattaagtttgttgttaaatctttcggcctaaccggaagcttgcagcgaaaactgataggcttgagggtgaaagagaggagcggaattctcggagtagcggtaaaatgcgtagatctcgagaggaacaccgatggcgaaagcagctccttggttcacacctgacgttgaaacacgaaagcgtggggagcaaacagg

SEQ ID NO: 2407 - DNA, 253 bp, Unknown
  Description of Unknown: bacterium polynucleotide
  SJA-4
tacgagtggtgcgagcattattcggaatcattgggcgtaaagggtgtgtaggcggtatatcaagtctgttgttaaatctcccggcctaaccgggaatatgcggtggaaactaatgtactagaagatggaagagagaagtggaattctcggagtagcggtaaaatgcgtagatctcgagaggaacaccaatggcgaaggcagcttcttggtccaattttgacgctgagacacgaaagcgtgggtagcaaacagg

SEQ ID NO: 2408 - DNA, 253 bp, Unknown
  Description of Unknown: bacterium polynucleotide
  SJA-4
gacgaggggtgcaaacgttattcggaatgattgggcgtaaagggtgcgcaggcggtatattaagtcaactgttaaattcctcagcctaactgaggcccagcggtagatactggtatacttgagagtggaagagagaagtggaattctcggagtagcggtaaaatgcgtagatctcgagaggaacaccgatggcgaaggcagcttcttggtccatttctgacgctcatgcacgaaagcgcggggagcaaacagg

SEQ ID NO: 2409 - DNA, 253 bp, Unknown
  Description of Unknown: bacterium polynucleotide
  SJA-4
tacgaagggtgcgagcgttattcggaattattgggcgtaaagggtgtgtagacggtatattaagtctgttgttaaatcttctggcctaaccagaaatctgcagtagatactgatgtgctagagggtggaagagagaagtggaattctcggagtagcggtaaaatgcgtagatctcgagaggaacaccaatggcgaaggcagcttcttggtccatacctgacgttgaggcacgaaagcgtggggagcaaacagg

SEQ ID NO: 2410 - DNA, 253 bp, Unknown
  Description of Unknown: bacterium polynucleotide
  SJA-4
tacgaggggtgcaagcgttattcggaattattgggcgtacagggtgcgtagacggtatgttaagtcaactgttaaattccccggcttaaccgggggtcagcggtagatactggcgtgctagaggatggaagagagaagtggaattctcggagtagcggtaaaatgcgtagatctcgagaggaacaccgatggcgaaggcagcttcttggtccatatctgacgttgaggcacgaaagcgtggggagcaaacagg

SEQ ID NO: 2411 - DNA, 253 bp, Unknown
  Description of Unknown: bacterium polynucleotide
  SJA-4
tacgaagggtgcaagcgttattcggattgattgggcgtaaagggtgcgcagacggtatgttaagtcgattgttaaatttcccagcctaactgggagcaagcggttgaaactggcaaactagaggatggaagagagaagtggaattctcggagtagcggtaaaatgcgtagatctcgaggggagcaccgatggcgaaggcagcttcttggtccatttctgacgttcatgcacgaaagcgcgggtagcaaacagg

SEQ ID NO: 2412 - DNA, 253 bp, Unknown
  Description of Unknown: bacterium polynucleotide
  SJA-4
tacgaagggtgctaacgttattcggaataattgggcgtaaagggtgcgcaggctgtatgttaagtcaactgttaaagtctccggcctaaccgggggtctgcggtagatactggcaaactagagtatgggagagagaagtggaattctcggagtagcggtaaaatgcgtagatctcgagaggaacactgatggcgaaggcagcttcttggcccattactgacgctcatgcacgaaagcgtggggagcaaacagg

SEQ ID NO: 2413 - DNA, 253 bp, Unknown
  Description of Unknown: bacterium polynucleotide
  SJA-4
tacgaggggtgcaagcgttattcggaataattgggtgtaaagggcgcgtagacggcgtgttaagtttgttgttaaatcctccggctcaaacggagatatgcggcaaatactagcatgctagaggatggaagagagaagtggaattcttggagtagcggtaaaatgcgtagatctcaagaggaacaccgatggcgaaggcagcttcttggtccattcctgacgttcaggcgcgaaagcgtggggagcaaacagg

SEQ ID NO: 2414 - DNA, 251 bp, Unknown
  Description of Unknown: bacterium polynucleotide
  SJA-4
tacagagggtgcaagcgttattcggagtgattgggtgtaaggggtgcgtaggcggtatgttagtcaattgttaaatttctcagcttaactgggagtcggcagttgatactggcgtgctagagggtggaagagagaagtggaattctcggagtagcggtaaaatgcgtagatctcgagaggaacaccatggcgaaggcagctttttggtccattcctgacgctgaggcacgaaagcatggggagcaaacagg

SEQ ID NO: 2415 - DNA, 254 bp, Unknown
  Description of Unknown: bacterium polynucleotide
  SJA-4
tacgaggggtgcaaacgttattcggaattactgggtgtaaagggtacgtagacggcattctaagtcaattgttaaattccccggcctaactgggggtaggcgattgaaactagaaagctagagagtggaagagagaagtggaattctcggagtggcggtaaaatgcgtagatctcgagaggaacaccgatggcgaaggcagcttcttggtccatattctgacgttgaggtacgaaagcgtggggagcaaacagg

SEQ ID NO: 2416 - DNA, 253 bp, Unknown
  Description of Unknown: bacterium polynucleotide
  SJA-4
tacgagtggtgcaagcgttattcggattaattgggcgtaaagggtgcgcaggcggcgcattaagtcaactgttaaatgcctcagcctaactgaggaccagcagtagatactggtgtgctagagagtggaagagagaagtggaattcttggagtagcggtaaaatgcgtagacctcaagaggaacaccaatggcgaaggcagctgcttggtccattcctgacgctcatgcacgaaagcgtggggagcaaacagg

SEQ ID NO: 2417 - DNA, 253 bp, Unknown
  Description of Unknown: bacterium polynucleotide
  SJA-4
tacgagaggtgcaagcgttattcggaatcattgggcgtaaagggtgcgtagacggtatgttaagtctgttgttaaatctttcggcttaaccgaaaatctgcaatggaaactggcatgctagagtatggaagagataagtggaattcttggagtagcggtaaaatgcgtagatctcaagaggaacaccgatggcgaaggcagcttattggtccattactgacgttgaggcacgaaagcgtggggagcaaacagg

SEQ ID NO: 2418 - DNA, 253 bp, Unknown
  Description of Unknown: bacterium polynucleotide
  SJA-4
tacggagggtgcaagcattgatcggaattactgggcgtaaagggtgcgtagacggtatgttaggttcgttgttaaaggctctggcctaactggagtaccgcaatgaaaactggcgtgctagagggtgagagagagaagtggaattcccggagtagcggtaaaatgcgtggatctcgggaggaacaccaatggcgaaggcagcttcttggctcattcctgacgttgaggcacgaaagcgtggggagcaaacagg

SEQ ID NO: 2419 - DNA, 253 bp, Unknown
  Description of Unknown: bacterium polynucleotide
  SJA-4
tacgaggggtgcaagcgttattcggaatcattgggcgtaaagggtgcgtggacggcttattaagtcaactgttaaattctccggcctaactggaggtcagcagtagaaactgataggcttgaggttggaagagaggagtggaattctcggagtagcggtaaaatgcgtagatctcgagaggaacaccgatggcgaaggcagctccttggtccatacctgacgttgaggcacgaaagcgtggggagcaaacagg

SEQ ID NO: 2420 - DNA, 253 bp, Unknown
  Description of Unknown: bacterium polynucleotide
  SJA-4
tacgaagggtgcaagcgttattcggaatcactgggcgtaaagggtgtgtagacggtttattaagttcgtcgttaaaggctccggcctaactggagtaccgcgatgaaaactggttgactagggggtgagagagagaagtggaattcctggagtagcggtaaaatgcgtggatctcaggaggaacaccaatggcgaaggcagcttcttggctcattcctgacgttgaggcacgaaagcgtggggagcaaacagg

SEQ ID NO: 2421 - DNA, 253 bp, Unknown
  Description of Unknown: bacterium polynucleotide
  SJA-4
tacggagggtgcaagcattaatcggatttattgggcgtaaagggtgcgtaggcggcatattaagtcaactgttaaattccctggcctaaccgggggcaagcggtagatactgatgtgctagaggatggaagagagaagtggaactctcggagtagcggtaaaatgcgtagatctcgagaggaacaccgatggcgaaggcagcttcttggtccatatctgacgctgaggcacgaaagcgtggggagcaaacagg

SEQ ID NO: 2422 - DNA, 253 bp, Unknown
  Description of Unknown: bacterium polynucleotide
  SJA-4
tacgaggggtgcaagcgttattcggaatcattgggcgtaaagggtgcgtagacggcttattaagtcaactgttaaattctccggcctaactggaggtcagcggtagaaactaataagcttgaggttggaagagagaagtggaattctcggagtagcggtaaaatgcgtagatctcgagaggaacaccgatggcgaaggcagcttcttggtccaaatctgacgttgaggcacgaaagcgtggggagcaaacagg

SEQ ID NO: 2423 - DNA, 253 bp, Unknown
  Description of Unknown: bacterium polynucleotide
  SJA-4
gacgaggggtgcgaacgttattcggaatgattgggcgtaaagggtgcgtagacggcttgttaagtcaactgttaaatttctcagcctaactgggagtatgcggtagaaactggcaaacttgaggatggaagagagaagtggaattctcggagtagcggtaaaatgcgtagatctcgagaggaacaccgatggcgaaggcagcttcttagtccatatctgacgttgaggcacgaaagcgtggggagcaaacagg

SEQ ID NO: 2424 - DNA, 253 bp, Unknown
  Description of Unknown: bacterium polynucleotide
  SJA-4
tgcgagtggtgctagcgttattcggagtaattgggcgtaaagggtgtgtaggcggtatattaagtcaattgttaaagaccttggcctaactaaggaaaggcagttgaaactgatatgcttgagggtggaagagagaagtggaattctcggagtagcggtaaaatgcgtagatctcgagaggaacaccgatggcgaaggcagcttcttggtccacatctgacgctgaggcacgaaagcgtggggagcaaacagg

SEQ ID NO: 2425 - DNA, 253 bp, Unknown
  Description of Unknown: bacterium polynucleotide
  SJA-4
tacgaagggtgcgagcgttattcggaatcactgggcgtaaagggtgcgtagacggcttgttaagtttgttgttaaagactctagcctaactggagggttgcaatgaaaactggcagactagagggtgagagagagaagtggaattcctggagtagcggtaaaatgcgtggatctcaggaggaacaccaatggcgaaggcagcttcttggctcattcctgacgttgaggcacgaaagcgtggggagcaaacagg

SEQ ID NO: 2426 - DNA, 253 bp, Unknown
  Description of Unknown: bacterium polynucleotide
  SJA-4
tacggagggtgcaagcgttagtcggaattactgggcgtaaagggtgcgtagatggcatgttaagttcgttgttaaaggctccggcctaaccggagtattgcgatgaaaactggcgtactagagggtgagagagagaagtggaattcccggagtagcggtaaaatgcgtggatctcgggaggaacaccaatggcgaaggcagcttcttggctcattcctgacattgaggcacgaaagcgtggggagcaaacagg

SEQ ID NO: 2427 - DNA, 253 bp, Unknown
  Description of Unknown: bacterium polynucleotide
  SJA-4
tacgagtggtgcaagcgttattcggaatcattgggcgtaaagggtgtgtagacggcactttaagtcaactgtttaattctccagcctaactggaggtcagcggtagaaactgatgtgctagagggtggaagagagaagtggaattctcggagtagcggtaaaatgcgtagatctcgagaggaacaccaatggcgaaggcagcttcttggtccactcctgacgttgaaacacgaaagcgtggggagcaaacagg

SEQ ID NO: 2428 - DNA, 253 bp, Unknown
  Description of Unknown: bacterium polynucleotide
  SJA-4
tacgaagggtgcaagcgttattcggaattattgggcgtaaagggtgcgtagacggcgtattaagtctgttgttgaatcttccggcctaaccggaaatctgcagtagatactggtatgctagagggtggaagagagaagtggaattctcggagtagcggtaaaatgcgtagatctcgaggggaacaccaaaggcgaaggcagcttcttggtccaaatctgacgttgaggcacgaaagcgtggggagcaaacagg

SEQ ID NO: 2429 - DNA, 253 bp, Unknown
  Description of Unknown: bacterium polynucleotide
  SJA-4
tacgagtggtgctagcgttattcggatttattgggcgtaaagggtgcgtagacggtatgacaagtctgttgttaaattcctcggctcaactgaggatctgcgatggaaactgtcgtgctagaggatggaagagagaagtggaattcttggagtagcggtaaaatgcgtagatctcaagaggaacatcgatggcgaaggcagcttcttggtccattcctgacgttgagacacgacagcgtgggtagcaaacagg

SEQ ID NO: 2430 - DNA, 253 bp, Unknown
  Description of Unknown: bacterium polynucleotide
  SJA-4
tacgaagggtgcaagcgttattcggattgattgggcgtaaagggtgcgcagacggcgcgttaagtcgattgttaaatttcccggcctaactgggagcaagcggttgaaactggcgtgctagagggtggaagagagaagtggaattctcggagtagcggtaaaatgcgtagatctcgaggggaacaccgacggcgagggcagcttcttggtccatttctgacgttcatgcacgaaagcgcgggtagcaaacagg

SEQ ID NO: 2431 - DNA, 253 bp, Unknown
  Description of Unknown: bacterium polynucleotide
  SJA-4
tacgaggggtgcaagcgttattcggaataattgggcgtaaagggtgcgtaggcggtgtattaagtccattgttaaatcccctagcttaactagggactcgcaacggatactggtgtgctagaggatggaagagaaaggtggaactcttggagtagcggtaaaatgcttagatcccaagaggaacaccgatggcgaaggcagccttttggtccattcctgacgctgaggcacgaaagcgtggggagcaaacagg

SEQ ID NO: 2432 - DNA, 253 bp, Unknown
  Description of Unknown: bacterium polynucleotide
  SJA-4
tacgaagggtgcaaacgttattcggaatcactgggcgtaaagggtgtgtagacggcatactaagttcgttgtttaatcttccggcctaaccggaagctcgcgatggaaactggtaagcttgaggatggaagagagaagtggaattctcggagtagcggtaaaatgcgtagatctcgagaggaacaccgatggcgaaggcagcttcttggtccactcctgacgttgagacacgaaagcgtgggtagcaaacagg

SEQ ID NO: 2433 - DNA, 253 bp, Unknown
  Description of Unknown: bacterium polynucleotide
  SJA-4
tacgagaggtgcgagcgttattcggaatgattgggcgtaaagggtacgtaggcggtatattaagtcaactgttaaatcctccggcctaactggagatatgcggtagaaactgatttgctagagggtggaagagagaagtggaattcttggagtagcggtaaaatgcgtagatctcaagaggaacaccaatggcgaaggcagcttcttggtccattcctgacgctgaggtacgaaagcgtggggagcaaacagg

SEQ ID NO: 2434 - DNA, 253 bp, Unknown
  Description of Unknown: bacterium polynucleotide
  SJA-4
tacgaggggtgcaaacgttattcggatttattgggtgtaaagggtgtgtagacggtttattaagttcgttgttaaatctttcggctcaaccggaagcttgcggtgaaaactgatagactagaggatgaaagagaggagtggaattctcggagtagcggtaaaatgcgtagatctcgagaggaacaccgatggcgaaagcagctccttggttcattcctgacgttgaaacacgaaagcgtggggagcaaacagg

SEQ ID NO: 2435 - DNA, 253 bp, Unknown
  Description of Unknown: bacterium polynucleotide
  SJA-4
tacgaagggtgcaagcgttattcggattgactgggcgtaaagtgtgtgtagacggtatgttaagtctgttgttaaattctctggctcaactagagatcagcggcagaaactaatgtgctagagggcggaagagagaagtggaattctcggagtagcggtaaaatgcgtagatctcgagaggaacaccaatggcgaaggcagcttcttggtccgcttctgacgttgagacacgaaagcgtggggagcaaacagg

SEQ ID NO: 2436 - DNA, 253 bp, Unknown
  Description of Unknown: bacterium polynucleotide
  SJA-4
tacgaggggtgcaagcgttattcggaatgattgggcgttaagggtgcgtaggcggtgtgctaagtctgttgttaaatacctcggcctaaccgaggacaagcatcagatactggcatgctagagggtggaagagagaagtggaattcttggagtagcggtaaaatgcttagatctcaagaggaacaccaatggcgaaggcagcttcttggtccattcctgacgctgaggcacgaaagcgtggggagcaaacagg

SEQ ID NO: 2437 - DNA, 253 bp, Unknown
  Description of Unknown: bacterium polynucleotide
  SJA-4
tacgaagggtgcgagcgttattcggagtgattgggcgtaaagggtgtgtaggcggtgcgttaagtcaattgttaaatttctcggcctaaccgagggtcagcggttgatactggcgtgcttgaggatggaagagagaagcggaattctcggagtagcggtaaaatgcgtagatctcgagaggaacgccgatggcgaaggcagcttcttggtccattcctgacgttcaagcacgaaagcgtggggagcaaacagg

SEQ ID NO: 2438 - DNA, 253 bp, Unknown
  Description of Unknown: bacterium polynucleotide
  SJA-4
tacgaagggtgcaagcgttattcggaatgactgggcgtaaagggtgtgtaggcggtatgttaagcttgctgttaaattctccggcctaactggagacatgcagtgagaactggcaagctagaggatgagagagagaagtggaattcccggagtagcggtaaaatgcgtagatctcgggaggaacaccgatggcgaaggcagcttcttggctcattcctgacgctgaaacacgaaagcgtggggagcaaacagg

SEQ ID NO: 2439 - DNA, 253 bp, Unknown
  Description of Unknown: bacterium polynucleotide
  SJA-4
tacgaagggtgcgagcgttattcggaatgattgggcgtaaagggtgcgcaggcggtatgttaagtcaattgttaaattcttcggcctaaccggaggtatgcaatagatactgatgtactagagggtggaagagagaagcggaattctcggagtagcggtaaaatgcgtagatctcgagaggaacaccgatggcgaaggcagcttcttggtccatttctgacgctcatgcacgaaagcgtggggagcaaacagg

SEQ ID NO: 2440 - DNA, 253 bp, Unknown
  Description of Unknown: bacterium polynucleotide
  SJA-4
tacgagtggtgcaagcgttattcggaatcattgggcgtaaagggtgtgtagacggtatgccaagtcaactgtttaattctccggcctaaccggagtccagcggtagatactagcgtactagagggtggaagagagaagtggaattctcggagtagcggtaaaatgcgtagatctcgagaggaacaccaatggcgaaggcagcttcttggtccatacctaacgttgagacacgaaagcgtggggagcaaacagg

SEQ ID NO: 2441 - DNA, 253 bp, Unknown
  Description of Unknown: bacterium polynucleotide
  SJA-4
tacgaggggtgcaagcgttattcggattgattgggtgtaaagggtgtgcagacggcttattaagtcacttgttaaattcttcggcctaactgaaggtccgcaagtgatactgacaagctagagggtggaagagagaagtggaattctcggagtagcggtaaaatgcgtagatctcgagaggaacaccaatggcgaaggcagcttcttggtccattcctgacgttcatacacgaaagcgtggggagcaaacagg

SEQ ID NO: 2442 - DNA, 253 bp, Unknown
  Description of Unknown: bacterium polynucleotide
  SJA-4
gacgaggggtgcaaacgttattcggaatgattgggcgtaaagggtgcgcaggcggctcattaagtcaatcgttaaattccccggcctaaccgggggtcagcgatagaaactgataagcttgagggtggaagagagaagtggaattctcggagtagcggtaaaatgcgtagatctcgagaggaacaccgatggcgaaggcagcttcttggtccatttctgacgctcatgcacgaaagcgtggggagcaaacagg

SEQ ID NO: 2443 - DNA, 253 bp, Unknown
  Description of Unknown: bacterium polynucleotide
  SJA-4
tacgagaggtgcaagcgttattcggaattattgggcgtaaagggtgcgcaggcggcatattaagtcaatcgtttaattcctcggcctaactgaggatcagcggtagaaactgataagctagagggcgagagagagaagcggaattctcggagtagcggtaaaatgcgtagatctcgagaggaacaccgatggcgaaggcagcttcttggctcgtttctgacgctcatgcacgaaagcgtggggagcaaacagg

SEQ ID NO: 2444 - DNA, 253 bp, Unknown
  Description of Unknown: bacterium polynucleotide
  SJA-4
tacgagtggtgcaagcgttattcggaatcattgggcgtaaagggtgtgtaggtgacaaattaagtctgttgttaaatttcccggcctaaccgggacaatgcggtggaaactgatttgatagaggttggaagagagaagtggaattcttggagtagcggtaaaatgcgtagatatcaagaggaacaccgatggcgaaggcagcttcttggtccatacctgacactgagacacgaaagcgtggggagcaaacagg

SEQ ID NO: 2445 - DNA, 254 bp, Unknown
  Description of Unknown: bacterium polynucleotide
  SJA-4
tacgaggggtgcaagcgttattcggatttattgggcgtaaagggtgcgtaggcggcatattaagtcagttgtcaaatttcctggcctaaccaggagcttgcggttgatactgatgtgctagaggatggaagagagaagtggaattctcggagtagcggtagaatgcgtagatctcgagaggaacaccgatggcgaaggcagcttcttggtccatatctgacgctgagtgcacgaaagcgtggggagcaaacagg

SEQ ID NO: 2446 - DNA, 253 bp, Unknown
  Description of Unknown: bacterium polynucleotide
  SJA-4
tacgaagggtgcgagcgttattcggaatgattgggcgtaaagggtgcgcagacggtatgttaagtcaactgttaaatattctggcctaactggaattcagcagtagaaactggcgtacttgagggtggaagagagaagtggaattctcggagtagcggtaaaatgcgtagatctcgagaggaacaccgatggcgaaggcagcttcttggtccatacctgacgttcatgcacgaaagcgtggggagcaaacagg

SEQ ID NO: 2447 - DNA, 253 bp, Unknown
  Description of Unknown: bacterium polynucleotide
  SJA-4
tacggggggtgcaagcgttattcggaatgattgggcgtaaagagtgcgtaggcggtgcgttaagtctatcgttaaattccctggcttaactaggggcatgcgatggatactggcgtgctagaggatgagagagagaagtggaattctcggagtagcggtaaaacgcttagatctcgagaggaacaccaatggcgaaggcagcttcttggttcattcctgacgctgaggtacgaaagcgtggggagcaaacagg

SEQ ID NO: 2448 - DNA, 254 bp, Unknown
  Description of Unknown: bacterium polynucleotide
  SJA-4
tacgaggggtgcaaacgttattcggaattactagggcgtaaagggtgcgtagacggtgcgttaagtctgttgtgaaagactctggcctaactggagaggtgcaatagatactggcgtgctagaggatggaagagagaagtggaattcccggagtagcggtaaaatgcgtagatctcgggaggaacaccgatggcgaaagcagcttcttggtccattcctgacgttgaggcacgaaagcgtggggagcaaacagg

SEQ ID NO: 2449 - DNA, 253 bp, Unknown
  Description of Unknown: bacterium polynucleotide
  SJA-4
tacgaagggtgcaagcgttattcggaatgattgggcgtaaagggtgcgtagacggtatgttaagtcaactgttaaatttcccagcctaactgggagcaagcagtagaaactggcgtactagagggtggaagagagaagtggaattctcggagtagcggtaaaatgcgtagatctcgagaggaacaccaatggcgaaggcagcttcttggtccatttctgacgttcatgcacgaaagcgtgggcagcaaacagg

SEQ ID NO: 2450 - DNA, 253 bp, Unknown
  Description of Unknown: bacterium polynucleotide
  SJA-4
tacgagtggtgcaagcgttattcggaatcattgggcgtaaagggcgcgtagacggtatgttaagtctgttgttaaattccttagcttaactaagggtatgcagcggaaactgatgtgctagaggatgggagagagaagtggaattctcggagtagcggtaaaatgcgtagatctcgagaggaacaccaacggcgaaggcagcttcttggtccatttctgacgttgaggcgcgaaagcgtggggagcaaacagg

SEQ ID NO: 2451 - DNA, 257 bp, Unknown
  Description of Unknown: bacterium polynucleotide
  SM2F11
tacagagacctcaagcgttatccggaatcattgggcgtaaagcgtaccgataggtggttaagaaagtcagatgtgaaatctccgagctcaactcggaatctgtcatttgaaacttcttgactagaggggcaaagaggaagctggaacgaacggtgtagtagtgaaatgcgttgatatcgttcggaacaccaatagcgtaggcaggcttctgggtgccacctgacactgctaggacgaaagcgtggggagcgaatggg

SEQ ID NO: 2452 - DNA, 257 bp, Unknown
  Description of Unknown: bacterium polynucleotide
  SM2F11
tacggaggatccaagcgttatccggatttattgggtgtaaagcgtaccgataggtggtttagaaagtcagaagtgaaatctctcagcttaactgggagactgtcttttgaaacttctaaactagaggggcaaagaggaagctggaacgaacggtgtagtagtgaaatgcgttgatatcgttcggaacaccaatagcgtaggcaggcttctgggtgccacctgacactgctaggacgaaagcgtggggagcgaacagg

SEQ ID NO: 2453 - DNA, 257 bp, Unknown
  Description of Unknown: bacterium polynucleotide
  SM2F11
tacggagggtgcaagcgttatctggaatcattgggcgtaaagcgtaccgataggtggttatacaagtcagaagtgaaatctccgagctcaactcggaatctgtcttttgaaactgtatgactagaggggcaaagaggaagctggaacgaacggtgtagtagtgaaatgcgttgatatcgttcggaacaccaatagcgtaggcaggcttctgggtgccacctgacactgctaggacgaaagcgtggggagcgaatggg

SEQ ID NO: 2454 - DNA, 253 bp, Unknown
  Description of Unknown: bacterium polynucleotide
  Solibacteres
tacgtaggcagcaagcgttgttcggaattactgggcgtaaagagtatgtaggcggtgctctaagtttggtgtgaaatctcccggcttaaccgggagcctgcatcgaagactggagtgcttgagggtgggagaggtaagcggaattcctggtgtagcggtgaaatgcgtagatatcaggaggaacacctgtggtgtagacagcttgctggaccatttctgacgctgagatacgaaagcgtgggtagcaaacagg

SEQ ID NO: 2455 - DNA, 253 bp, Unknown
  Description of Unknown: bacterium polynucleotide
  Solibacteres
tacgtaggcagcaagcgttgttcggaattactgggcgtaaagagtgtgtaggcggtgttctaagtctgttgtgaaatctcccggtttaactgggagggtgcggcggagactggaatgctagagtatgggagaggtaagcggaattcctggtgtagcggtgaaatgcgtagatatcaggaggaacacctgtggtgtagacagcttactggaccatgactgacgctgagacacgaaagcgtgggtagcaaacagg

SEQ ID NO: 2456 - DNA, 253 bp, Unknown
  Description of Unknown: bacterium polynucleotide
  Solibacteres
tacgtaggcagcaagcgttgttcggaattactgggcgtaaagagtgtgtaggcggtgctctaagtctggtgtgaaatctcccggctcaactgggagggtgcgctagaaactggaatgctagaggatgggagaggtaagcggaattcctggtgtagcggtgaaatgcgtagatattgggaagaacaccggtggcgtaggcgactagctgggccataactgacgctgaggaacgaaagccagggtagcgaatggg

SEQ ID NO: 2457 - DNA, 253 bp, Unknown
  Description of Unknown: bacterium polynucleotide
  Solibacteres
tacgtaggcagcaagcgttgttcggaattactgggcgtaaagagtgtgtaggcggtgctctaagtttggtgtgaaatctcccggcttgactgggagggtgcgccgaaaactggagtgcttgagtatgggagaggtaagcggaattcctggtgtagcggtgaaatgcgtagatatcaggaggaacacctgtggtgtagacagcttactggaccatcactgacgctgagacacgaaagcgtgggtagcaaacagg

SEQ ID NO: 2458 - DNA, 253 bp, Unknown
  Description of Unknown: bacterium polynucleotide
  Solibacteres
tacgtaggcagcaagcgttgttcggaattactgggcgtaaagagtgtgtaggcggtgctctaagtctgttgtgagatctcccggcttaaccgggagggtgcggcggaaactggagtgcttgagggtgggagaggtaagcggaattcctggtgcagcggtgaaacgcgtagatatcaggaggaacacctgtggtgtagacagcttactggaccacttctgacgctgagacacgaaagcgtgggtagcaaacagg

SEQ ID NO: 2459 - DNA, 253 bp, Unknown
  Description of Unknown: bacterium polynucleotide
  Solibacteres
tacgtaggcagcgagcgttgttcggagttactgggcgtaaagagtgcgtaggcggttccgtaagtttgttgtgaaatctcccggcttaactgggagggtgcggcgaaaactgcggggcttgagtgtgggagaggtaagcggaattcctggtgtagcggtgaaatgcgtagataacaggaggaacaccggcggtgtaggcggcttactggaccatgactgacgctgaggcacgaaagcgtggggagcaaacagg

SEQ ID NO: 2460 - DNA, 253 bp, Unknown
  Description of Unknown: bacterium polynucleotide
  Solibacteres
tacgtaggcagcaagcgttgttcggagttactgggcgtaaagagtgcgtaggcggtcctgtaagtttggtgtgaaatctcccggctcaactgggagggtgcgccgaagactgcagggcttgagtatgggagaggtaagcggaattcctggtgtagcggtgaaatgcgtagatatcaggaggaacacctgtggtgtagacagcttactggaccataactgacgctgaggcacgaaagcgtgggtagcaaacagg

SEQ ID NO: 2461 - DNA, 253 bp, Unknown
  Description of Unknown: bacterium polynucleotide
  Solibacteres
tacgtaggcagcgagcgttgttcggagttactgggcgtaaagcgtgcgtaggcggtggcccaagtctggtgtgaaatctcccggcttaactgggagggtgcgccggaaactgggttgctggagtactggagaggcaagcggaattcctggtgtagcggtgaaatgcgtagatatcaggaggaacacccgtggtgtagacggcttgctggacggtcactgacgctgaggcacgaaagcgtggggagcaaacagg

SEQ ID NO: 2462 - DNA, 253 bp, Unknown
  Description of Unknown: bacterium polynucleotide
  Solibacteres
tacgtaggcagcaagcgttgttcggagttactgggcgtaaagagtgcgtaggcggtttaccaagtctgctgtgaaatctcccggcttaactgggagggtgcggtggaaactggtaggctcgagtgtgggagaggtaagcggaattcctggtgtagcggtgaaatgcgtagatatcaggaggaacaccggtggtgtagacggcttactggaccacgactgacgctgaggcacgaaagcgtgggtagcaagcggg

SEQ ID NO: 2463 - DNA, 253 bp, Unknown
  Description of Unknown: bacterium polynucleotide
  Solibacteres
tacgtaggcagcgagcgttgttcggagttactgggcgtaaagcgtgcgtaggcggttttgtaagtttggtgtgaaatctcccggctcaactgggagggtgcgccgaaaactgcaaggctggagtgtgggagaggtaggcggaattcctggtgtagcggtgaaatgcgtagatatcaggaggaacacctgtggtgtagacggcttactggaccatgactgacgctgaggcacgaaagcgtggggagcaaacagg

SEQ ID NO: 2464 - DNA, 253 bp, Unknown
  Description of Unknown: bacterium polynucleotide
  Solibacteres
tacgtaggcagcaagcgttgttcggagttactgggcgtaaagagtgtgtaggcggttggccaagtctggtgtgaaatctcccggcttaactgggagggtgcgccggaaactggtcggctagagtgtgggagagggaagcggaattcctggtgtagcggtggaatgcgtagatatcaggaggaacacccgcggtgtagacggcttcctggaccgtaactgacgctgagatacgaaagcgtggggagcaaacagg

SEQ ID NO: 2465 - DNA, 253 bp, Unknown
  Description of Unknown: bacterium polynucleotide
  Solibacteres
tacgtaggcagcgagcgttgttcggagttactgggcgtaaagcgtgcgtaggcggttgtctaagtttggtgtgaaatctcctggcttaactgggagggtgcgccgaaaactgggtgactggagtgtcggagaggtaagcggaattcctggtgtagcggtgaaatgcgtagagatcaggaggaacacctgtggtgtagacagcttactggacgataactgacgctgaggcacgaaagcgtgggtagcaaacagg

SEQ ID NO: 2466 - DNA, 253 bp, Unknown
  Description of Unknown: bacterium polynucleotide
  Solibacteres
tacgtaggcagcgagcgttgttcggagttactgggcgtaaagagtgcgtaggcggttttctaagtttggtgtgaaatctcccggctcaactgggagggtgcgccgaagactggaaggctagagtatgggagaggtaagcggaattcctggtgtagcggtgaaatgcgtagatatcaggaggaacacctgcggtgtagacggcttactggaccatcactgacgctgaggcacgaaagcgtgggtagcaaacagg

SEQ ID NO: 2467 - DNA, 253 bp, Unknown
  Description of Unknown: bacterium polynucleotide
  Solibacteres
tacgtaggcagcgagcgttgttcggagttactgggcgtaaagcgtgcgtaggcggtgtcttaagtttgttgtgaaatctcccggcttaaccgggagggtgcggcgaatactgagatgctggagtgcgggagaggtaagcggaattcctggtgtagcggtgaaatgcgtagatatcaggaggaataccgatggcgaaggcaggtctctgggctgacactgacgctcatgcacgaaagcgtggggagcaaacagg

SEQ ID NO: 2468 - DNA, 253 bp, Unknown
  Description of Unknown: bacterium polynucleotide
  Solibacteres
tacgtaggcagcaagcgttgttcggaattactgggcgtaaagagtgtgtaggcggtgctctaagtttggtgtgaaatctcccggcttaaccgggaggctgcattgaatactggagtgctagagggtgggagaggtaagcggaattcctggtgtagcggtgaaatgcgtagatatcaggaggaacacctgtggtgtagacagcttactggaccacttctgacgctgagacacgaaagcgtgggtagcaaacagg

SEQ ID NO: 2469 - DNA, 253 bp, Unknown
  Description of Unknown: bacterium polynucleotide
  Solibacteres
tacgtaggcagcaagcgttgttcggagttactgggcgtaaagagtgcgtaggcggtgccctaagtctggtgtgaaatctcccggctcaaccgggagggtgcgccggaaactggggtgctcgagtgtgggagaggcaggcggaattcccggagtagcggtgaaatgcgtagatatcgggaggaacacccgcggtgtagacggcctgctggaccactactgacgctgaggcacgaaagcgtggggagcaaacagg

SEQ ID NO: 2470 - DNA, 253 bp, Unknown
  Description of Unknown: bacterium polynucleotide
  Solibacteres; Bryobacteraceae
tacgtaggcagcgagcgttgttcggaattactgggcgtaaagagtgtgtaggtggtgtcgtaagtttggtgtgaaatctcccggcttaactgggagggtgcgccgaagactgcgatgctggagtatgggagaggaaagcggaattcctggtgtagcggtgaaatgcgtagatatcaggaggaacacctgcggtgtagacggctttctggaccattactgacactgagacacgaaagcgtgggtagcaaacagg

SEQ ID NO: 2471 - DNA, 253 bp, Unknown
  Description of Unknown: bacterium polynucleotide
  Solibacteres; Solibacteraceae
tacgtaggcagcgagcgttgttcggaattactgggcgtaaagagtgtgtaggcggtgctctaagttcggtgtgaaatctcctggcttaactgggagggtgcgccggaaactggagtgctcgagcgtgggagaggaaagcggaattcctggtgtagcggtgaaatgcgtagatatcaggaggaacacctgcggtgtagacggctttctggaccattgctgacgctgagacacgaaagcgtgggtagcaaacagg

SEQ ID NO: 2472 - DNA, 253 bp, Unknown
  Description of Unknown: bacterium polynucleotide
  Solibacteres; Solibacteraceae
tacgtaggcagcaagcgttgttcggaattactgggcgtaaagagtgtgtaggcggtgctctaagttcggtgtgaaatctcccggcttaactgggagggtgcgccggaaactggagtgcttgagcgcgggagaggaaagcggaattcctggtgtagcggtgaaatgcgtagatatcaggaggaacacctgtggtgtagacggctttctggaccgtagctgacgctgagacacgacagcgtggggagcaaacagg

SEQ ID NO: 2473 - DNA, 253 bp, Candidatus solibacter
  Solibacteres; Solibacteraceae; Candidatus Solibacter
tacgtaggcagcaagcgttgttcggagttactgggcgtaaagggtgtgtaggcggttggataagtgtggtgtgaaatctcccggcttaactgggagggtgcgctacaaactgtctgactagagtgtgggatgggtaagtggaattcctggtgtagcggtgaaatgcgtagatatcaggaggaacaccggtggtgtagacggcttactggaccataactgacgctgagacacgaaagcgtgggtagcaaacagg

SEQ ID NO: 2474 - DNA, 254 bp, Candidatus solibacter
  Solibacteres; Solibacteraceae; Candidatus Solibacter
tacgtaggcagcgagcgttgttcggagttactgggcgtaaagggtgtgtaggcggttgtttaagtttggtgtgaaatctcccggctcaactgggagggtgcgccgaatactgaatgacttggagtgcgggagaggagagtggaattcctggtgtagcggtgaaatgcgtagatatcaggaggaacaccggtggtgtagacggctctctggaccgtaactgacgctgagacacgaaagcgtgggtagcaaacagg

SEQ ID NO: 2475 - DNA, 253 bp, Candidatus solibacter
  Solibacteres; Solibacteraceae; Candidatus Solibacter
tacgtaggcagcgagcgttgttcggagttactgggcgtaaagggtgtgtaggcggttgcttaagtttggtgtgaaatctcccggctcaaccgggagggtgcgccgaatactgagtgactagagtgcgggagaggaaagtggaattcctggtgtagcggtgaaatgcgtagatatcaggaggagcaccggtggtgtagacggctttctggaccgtaactgacgctgagacacgaaagcgtgggtagcaaacagg

SEQ ID NO: 2476 - DNA, 253 bp, Candidatus solibacter
  Solibacteres; Solibacteraceae; Candidatus Solibacter
tacgtaggcagcaagcgttgttcggagttactgggcgtaaagggtgcgtaggcggctttttaagtttggtgtgaaatctcccggctcaactgggagggtgcgccgaatactgagaggctagagtgtgggagaggaaagtggaattcctggtgtagcggtgaaatgcgtagatatcaggaggaacaccggtggtgtaaacggctttctggaccataactgacgctgaggcacgaaagcgtgggtagcaaacagg

SEQ ID NO: 2477 - DNA, 253 bp, Candidatus solibacter
  Solibacteres; Solibacteraceae; Candidatus Solibacter
tacgtaggcagcaagcgttgttcggagttactgggcgtaaagggtgtgtaggcggttctttaagtttgctgtgaaatctcccggcttaaccgggagggtgcggtgaatactgagggactagagtacgggagaggaaagtggaattcctggtgtagcggtgaaatgcgtagatatcaggaggaacaccggtggtgtagacggctttctggaccgacactgacgctgagacacgaaagcgtgggtagcaaacagg

SEQ ID NO: 2478 - DNA, 253 bp, Candidatus solibacter
  Solibacteres; Solibacteraceae; Candidatus Solibacter
tacgtaggcagcaagcgttgttcggagttactgggcgtaaagggtgtgtaggcggttcttttagtttggtgtgaaatctcccggcttaaccgggagggggcgccgaatactgagggactagagtacgggagaggaaagtggaattcctggtgtagcggtgaaatgcgtagatatcaggaggaacaccggtggtgtagacggctttctggaccgtaactgacgctgagacacgaaagcgtgggtagcgaacagg

SEQ ID NO: 2479 - DNA, 253 bp, Unknown
  Description of Unknown: bacterium polynucleotide
  Sphingobacteriia
tacgaaggatccaagcgttgtccggatttactgggtttaaagggtgcgtaggcggactattaagtcagtggtgaaagcttgcagcttaactgtaaaattgccattgaaactgatagtctcgaatatggttgaggtggttggaatgtatcatgtagcggtgaaatgcttagatatgatacagaacaccgattgcgaaggcagatcactaaaccattattgacgctgaggcacgaaagcgtggggatcagacagg

SEQ ID NO: 2480 - DNA, 253 bp, Unknown
  Description of Unknown: bacterium polynucleotide
  Sphingobacteriia
tacgaaggatccaagcgttatccggattcattgggtttaaagggagcgtaggcggacttataagtcagtggtgaaagccgatagcttaactatcgaactgccattgatactgtaggtctagagtacagatgatgttggcggaatatgacatgtagcggtgaaatgcatagatatgtcatagaacaccgattgcgaaggcagctgacaaaactgtaactgacgctgaggctcgaaagtgcggggatcaaacggg

SEQ ID NO: 2481 - DNA, 253 bp, Unknown
  Description of Unknown: bacterium polynucleotide
  Sphingobacteriia
gacgaaggatgcaagcgttatccggattcattgggtttaaagggagcgtaggcggccttataagtcagtggtgaaatctcctcgcttaacgaggaaattgccattgatactgtagggcttgagtacagttgccgttggcggaatatgacatgtagtggtgaaatacatagagatgtcatagaacaccgattgcgaaggcagctaacgaagctgtaactgacgctgaggctcgaaagtgcggggatcaaacagg

SEQ ID NO: 2482 - DNA, 253 bp, Unknown
  Description of Unknown: bacterium polynucleotide
  Sphingobacteriia
tacggaggatccaagcgttatccggatttattgggtttaaagggtgcgtaggcggatttttaagtcagtggtgaaagcctacagcttaactgtagaactgccattgatactgaaagtcttgagtacatatgaagtgggcggaatgtgcagtgtagcggtgaaatgcttagatattgcacagaacaccgattgcgaaggcagctcactaaactgtaactgacgctgaggcacgaaagtgtggggatcaaacagg

SEQ ID NO: 2483 - DNA, 253 bp, Unknown
  Description of Unknown: bacterium polynucleotide
  Sphingobacteriia
gacgaaggatgcaagcgttatccggattcattgggtttaaagggtgcgtaggcggacctgtaagtcagtggtgaaatctctcagcttaactgagaaactgccattgatactgcaagtctagagtatagatgacgttggcggaatatgacatgtagtggtgaaatacttagatatgtcatagaacaccgattgcgaaggcagctaacgaaactataactgacgctgaggcacgaaagtgcggggatcaaacagg

SEQ ID NO: 2484 - DNA, 253 bp, Unknown
  Description of Unknown: bacterium polynucleotide
  Sphingobacteriia
tacgaaggatccaagcgttgtccggatttactgggtttaaagggagcgtaggcggaacattaagtcagtggtgaaagcctggagcttaacttcagaattgccattgaaactgatgttctcgagtattgttgaggttactggaatgttgcatgtagcggtgaaatgcttagatatgcaacagaacaccaattgcgaaggcaggtaactaagcgataactgacgctgaggctcgaaagcgtggggagcaaacagg

SEQ ID NO: 2485 - DNA, 253 bp, Unknown
  Description of Unknown: bacterium polynucleotide
  Sphingobacteriia
tacgaaggtcccaagcgttatccggatttattgggtttaaagggtgcgtaggcgggttattaagtcagtggtgaaagccttcagcttaactgaagaactgccattgatactgatgatcttgagtatggttgaggtgggcggaatgtgtcatgtagcggtgaaatgcttagatatgacacagaacaccgattgcgaaggcagctcactaagtcataactgacgctgatgcacgaaagcgtggggagcaaacagg

SEQ ID NO: 2486 - DNA, 253 bp, Unknown
  Description of Unknown: bacterium polynucleotide
  Sphingobacteriia
gacagagggtgcaaacgttgtccggatttattgggtttaaagggtgcgtaggcggatctttaagtcagtggtgaaagcctgcagcttaactgtagaacagccattgaaactgaagatcttgaattaggttaaagtaggcggaatgtatcatgtagcggtgaaatgcttagatatgatacagaacaccgatagcgaaggcagcttgctgaacctacattgacgctgaggcacgaaagcgtggggagcaaacagg

SEQ ID NO: 2487 - DNA, 253 bp, Unknown
  Description of Unknown: bacterium polynucleotide
  Sphingobacteriia
tacggaggatccaagcgttatccggattcattgggtttaaagggtgcgtaggcggaatgataagtcagtggtgaaagcctgcagcttaactgcagaactgccattgatactgtcaatcttgagtacatttgatgtgggcggaatgtgtcatgtagcggtgaaatgcttagatatgacacagaacaccgattgcgaaggcagctcacaaaactgtaactgacgctgaggcacgaaagcgtgggtatcaaacagg

SEQ ID NO: 2488 - DNA, 253 bp, Unknown
  Description of Unknown: bacterium polynucleotide
  Sphingobacteriia
tacggaggatccaagcgttgtccggatttattgggtttaaagggtgcgtaggcgggttattaagtcagtggtgaaagccggcagctcaactgtcgaactgccattgaaactgatagcctagaatctagtagaggtaggcggaatgtatcatgtagcggtgaaatgcttagatatgatacagaacaccaattgcgaaagcagcttactatgctagtattgacgctgaggcacgaaagcgtggggatcaaacagg

SEQ ID NO: 2489 - DNA, 253 bp, Unknown
  Description of Unknown: bacterium polynucleotide
  Sphingobacteriia
tacgaaggtcccaagcgttatccggatttattgggtttaaagggtgcgtaggcgggctattaagtcagtggtgaaagcctcaagcttaacttgagaattgccattgatactgatgaccttgagtacatttgaagtgggcggaatgtgtcatgtagcggtgaaatgcttagatatgacacagaacaccgattgcgtaggcagctcactaaactgtaactgacgctgaggcacgaaagcgtggggagcaaacagg

SEQ ID NO: 2490 - DNA, 253 bp, Unknown
  Description of Unknown: bacterium polynucleotide
  Sphingobacteriia
gacgaaggatgcaagcgttatccggattcatcgggtttaaagggagcgtaggcggccctataagtcagtggtgaaatctctcggcttaaccgagaaattgccattgatactgtagggcttgagtacagttgccgttggcggaatatgacatgtagtggtgaaatacatagagatgtcatagaacaccgattgcgaaggcagctaacgaagctgtaactgacgctgaggctcgaaagtgcggggatcaaacagg

SEQ ID NO: 2491 - DNA, 253 bp, Unknown
  Description of Unknown: bacterium polynucleotide
  Sphingobacteriia
tacggaggatccaagcgttgtccggatttattgggtttaaggggtgcgtaggcggactaataagtcagaggtgaaagccggtagctcaactatcgaattgcctttgaaactatcagtcttgagttttgttgaggtaggcggaatgtatcatgtagcggtgaaatgcatagatatgatacagaacaccgattgcgaaggcagcttactaagcaaatactgacgctgaggcacgaaagcgtggggatcaaacagg

SEQ ID NO: 2492 - DNA, 253 bp, Unknown
  Description of Unknown: bacterium polynucleotide
  Sphingobacteriia
gacgaaggatgcaagcgttatccggattcattgggtttaaagggagcgtaggtggactggtaagtcagtggtgaaatctccgagcttaactcggaaattgccattgatactgtcggtcttgagtatagttgccgttggcggaatatgacatgtagtggtgaaatacatagagatgtcatagaacaccgattgcgaaggcagctgacgaaactataactgacactgaggctcgaaagtgtggggatcaaacagg

SEQ ID NO: 2493 - DNA, 253 bp, Unknown
  Description of Unknown: bacterium polynucleotide
  Sphingobacteriia
gacgaaggatgcaagcgttatccggattcattgggtttaaagggagcgtaggtggccttataagtcagcggtgaaatctctgggcttaacccagaaattgccattgatactgtagggcttgagtacagttgctgtgggcggaatatgacatgtagtggtgaaatacatagagatgtcatagaacaccgattgcgaaggcagctcacaaaactgtaactgacactgaggctcgaaagtgcggggatcaaacagg

SEQ ID NO: 2494 - DNA, 253 bp, Unknown
  Description of Unknown: bacterium polynucleotide
  Sphingobacteriia
gacgaaggatgcaagcgttatccggattcattgggtttaaagggagcgtaggtggccttataagtcagtggtgaaatcctgttgcttaacaatagaattgccattgatactgtagggcttgagtatagttgccgttggcggaatatgacatgtagtggtgaaatacatagagatgtcatagaacaccgattgcgaaggcagctaacgaaactataactgacaccgaggctcgaaagtgcggggatcaaacagg

SEQ ID NO: 2495 - DNA, 253 bp, Unknown
  Description of Unknown: bacterium polynucleotide
  Sphingobacteriia
gacgaaggatccaagcgttatccggattcattgggtttaaagggagcgtaggcgggtttataagtcagtggtgaaagccgatcgcttaacgatcgaactgccattgatactgtagacctagagtatagatgatgttggcggaatatgacatgtagcggtgaaatgcatagatatgtcatagaacaccgattgcgaaggcagctgacaaaactataactgacgctgaggctcgaaagtgcggggatcaaacagg

SEQ ID NO: 2496 - DNA, 253 bp, Unknown
  Description of Unknown: bacterium polynucleotide
  Sphingobacteriia
tacggaggatccaagcgttatccggatttactgggtttaaagggtgcgtaggtggaatgacaagtcagtggtgaaaacctatagcttaactatagaactgccattgatactgttattcttgagtgtatttgatgtaagtggaatgtgtcatgtagcggtgaaatgcttagatatgacacagaacacccattgcgaaggcagcttacaaaactacaactgacactgaggcacgaaagcgtggggatcaaacagg

SEQ ID NO: 2497 - DNA, 253 bp, Unknown
  Description of Unknown: bacterium polynucleotide
  Sphingobacteriia
tacgaaggtcccaagcgttatccggatttattgggtttaaagggtgcgtaggcgggctattaagtcagtggtgaaagccccaagcttaacttgggaactgccattgatactgatggtcttgagtacatttgaggtgggcggaatgtgccatgtagcggtgaaatgcttagatatgacacagaacaccgattgcgaaggcagctcactaaactgtaactgacgctgaggcacgaaagcgtggggagcaaacagg

SEQ ID NO: 2498 - DNA, 253 bp, Unknown
  Description of Unknown: bacterium polynucleotide
  Sphingobacteriia
tacggaggatccaagcgttgtccggatttattgggtttaaagggtgcgtaggcggacttataagtcagaggtgaaagccggtagcttaactatcgaattgcctttgaaactgcaagtcttgaattttgttgaggtaggcggaatgtatcatgtagcggtgaaatgcatagatatgatacagaacaccgattgcgaaggcagcttactaagcaaatattgacgctgaggcacgaaagcgtggggatcaaacagg

SEQ ID NO: 2499 - DNA, 253 bp, Unknown
  Description of Unknown: bacterium polynucleotide
  Sphingobacteriia
gacgaaggattcaagcgttgcccggatttactgggtttaaagggtgcgtaggcggaaatataagtcagtggtgaaatcccgcagctcaactgcggaactgccattgaaactgcatttcttgaatacggttgaggtagatgggatgtaacatgtagcggtgaaatgcttagatatgttacagaactccgattgcgaaggcagtctactaagccgttattgacgctgaggcacgaaagcgtggggatcaaacagg

SEQ ID NO: 2500 - DNA, 253 bp, Unknown
  Description of Unknown: bacterium polynucleotide
  Sphingobacteriia
tacggaggatccaagcgttatccggattcactgggtttaaagggtgcgtaggtggaatgacaagtcagtggtgaaaacctgcagcttaactgtagaactgccattgatactgttattcttgagtacatttgatgtgagcggaatgtgtcgtgtagcggtgaaatgcttagatatgacacagaacaccaattgcgaaggcagctcacaaaactgtaactgacactgaggcacgaaagcgtggggatcaaacagg

SEQ ID NO: 2501 - DNA, 253 bp, Unknown
  Description of Unknown: bacterium polynucleotide
  Sphingobacteriia
tacgaaggatccaagcgttgtccggatttactgggtttaaagggtgcgtaggcggatgtctaagtcagtggtgaaagccggcagcttaactgtcgaattgccattgaaactggacgtctcgagtgcggttgaggtggctggaatgtaacatgtagcggtgaaatgcatagatatgttacagaacaccgattgcgaaggcaggtcactaaaccgtaactgacgctgaggcacgaaagcgtggggatcaaacagg

SEQ ID NO: 2502 - DNA, 253 bp, Unknown
  Description of Unknown: bacterium polynucleotide
  Sphingobacteriia
tacgaaggacccgagcgttatccggatttattgggtttaaagggtgcgtaggcggattaataagtcagtggtgaaagcccgtcgcttaacgatggaactgccattgatactgttagtcttgagtatggttgaggtgggcggaatgtgtcatgtagcggtgaaatgcttagatatgacacagaacaccaattgcgaaggcagctcgccaaaccataactgacgctgaggcacgaaagcgtggggagcaaacagg

SEQ ID NO: 2503 - DNA, 253 bp, Unknown
  Description of Unknown: bacterium polynucleotide
  Sphingobacteriia
gacgaaggatgcaagcgttatccggattcattgggtttaaagggagcgtaggtggtcttataagtcagtggtgaaatctcgcagcttaactgcgaaattgccattgatactgtaggacttgagtacagttgccgttggcggaatatgacatgtagtggtgaaatacatagagatgtcatagaacaccgattgcgaaggcagctaacgaaactgtaactgacactgaggctcgaaagtgcgggaatcaaacagg

SEQ ID NO: 2504 - DNA, 253 bp, Unknown
  Description of Unknown: bacterium polynucleotide
  Sphingobacteriia
tacggaggatccaagcgttatccggatttattgggtttaaagggtgcgtaggcgggacagtaagtcagtggtgaaatcctatcgcttaacgatagaattgccattgatactgctgaccttgagtacaaatgatgtgggcggaatgtgcagtgtagcggtgaaatgcttagatattgcacagaacaccgatagcgaaggcagctcacaaaaatgtaactgacgctgaggcacgaaagtatggggatcaaacagg

SEQ ID NO: 2505 - DNA, 253 bp, Unknown
  Description of Unknown: bacterium polynucleotide
  Sphingobacteriia
gacgaaggattcaagcgttgtccggatttactgggtttaaagggtgcgtaggcggaactttaagtcagtggtgaaagctctcggctcaaccgagaaactgccattgaaactgattttcttgaatacagttgaggtaaatggaatataacatgtagcggtgaaatgcttagatatgttatagaacaccgattgcgaaggcagtctgctaagctgttattgacgctgaggcacgaaagcgtggggagcaaacagg

SEQ ID NO: 2506 - DNA, 253 bp, Unknown
  Description of Unknown: bacterium polynucleotide
  Sphingobacteriia
tacgaaggatccaagcgttgtccggatttactgggtttaaagggagcgtaggcggacttttaagtcagtggtgaaagcttgcagcttaactgtaaaattgccattgaaactgaaagtctcgagtatggttgaggtgactggaatatatcatgtagcggtgaaatgcttagatatgatatagaacaccaattgcgaaggcaggtcactaaaccataactgacgctgaggctcgaaagcgtggggatcaaacagg

SEQ ID NO: 2507 - DNA, 253 bp, Unknown
  Description of Unknown: bacterium polynucleotide
  Sphingobacteriia
gacgaaggatgcaagcgttatccggattcattgggtttaaagggagcgtaggcggtcctgtatgtcagtggtgaaatctcgcagcttaactgcgaaattgccattgatactgcaggacttgagtacagttgccgttggcggaatatgacatgtagtggtgaaatacatagagatgtcatagaacaccgattgcgaaggcagctaacgaaactgtaactgacgctgatgctcgaaagtgcggggatcaaacagg

SEQ ID NO: 2508 - DNA, 253 bp, Unknown
  Description of Unknown: bacterium polynucleotide
  Sphingobacteriia
gacgaaggatgcaagcgttatccggattcattgggtttaaagggagcgtaggtggccaaataagtcagtggtgaaatctctcagcttaactgagaaattgccattgatactgtatggcttgagtatagttgccgttggcggaatatgacatgtagtggtgaaatacatagagatgtcatagaacaccgattgcgaaggcagctgacgaaactataactgacactgaggctcgaaagtgcggggatcaaacagg

SEQ ID NO: 2509 - DNA, 253 bp, Unknown
  Description of Unknown: bacterium polynucleotide
  Sphingobacteriia
tacggaggatccaagcgttgtccggatttattgggtttaaagggtgcgtaggcggatatgcaagtcagaggtgaaagctagcagcttaactgttaaattgcctttgaaactgcatatcttgagtatagttgaggtgggcggaatgtatcatgtagcggtgaaatgcttagatatgatacagaactccgattgcgaaggcagctcactaagctataactgacgctgaggcacgaaagcgtgggtagcgaacagg

SEQ ID NO: 2510 - DNA, 253 bp, Unknown
  Description of Unknown: bacterium polynucleotide
  Sphingobacteriia
gacgaaggacccgagcgttatccggattcattgggtttaaagggtgcgtaggtggattggtaagtcagtggtgaaagccccaggctcaacttgggaactgccattgatactgctgatcttgagtgcatatgatgtgggcggaatatgacatgtagtggtgaaatacttagatatgtcatagaacaccgattgcgaaggcagctcacaaaactgcaactgacactgaggcacgaaagcgtggggatcaaacagg

SEQ ID NO: 2511 - DNA, 253 bp, Unknown
  Description of Unknown: bacterium polynucleotide
  Sphingobacteriia
tacgaaggattcgagcgttatccggatttattgggtttaaagggtgcgtaggtggactaataagtcagtggtgaaagcccgcagcttaactgcggaactgccattgatactgctagtcttgagtacagttgaggtgggcggaatgtgtcatgtagcggtgaaatgcttagatatgacacagaacaccgattgcgaaggcagctcactaagctgtaactgacactgaggcacgaaagcgtggggagcaaacagg

SEQ ID NO: 2512 - DNA, 253 bp, Unknown
  Description of Unknown: bacterium polynucleotide
  Sphingobacteriia
tacgaaggatccaagcgttgtccggatttactgggtttaaagggtgcgtaggcggacttttaagtcagtggtgaaagcctgtagcttaactatagaattgccattgaaactgaaagtctcgagtgtggttgaggtaactggaatatatcatgtagcggtgaaatgcttagatatgatatagaacaccaattgcgaaggcaggttactgagccacaactgacgctgaggcacgaaagcgtggggatcaaacagg

SEQ ID NO: 2513 - DNA, 253 bp, Unknown
  Description of Unknown: bacterium polynucleotide
  Sphingobacteriia
gacgaaggacccgagcgttatccggattcattgggtttaaagggtgcgtaggcggactgataagtcagtggtgaaatctccaggcttaacttggaaactgccattgatactgtcagtcttgaatctggctgatgtgggcggaatatgacatgtagcggtgaaatgcttagatatgtcatagaacaccgattgcgaaggcagctcacaaaaccagtattgacgctgaggcacgaaagtgcggggatcaaacagg

SEQ ID NO: 2514 - DNA, 253 bp, Unknown
  Description of Unknown: bacterium polynucleotide
  Sphingobacteriia
tacgaaggatccaagcgttgtccggatttactgggtttaaagggtgcgtaggcggacttttaagtcagtggtgaaagctcgcagcttaactgtgaaattgccactgaaactgaaagtctcgagtgtggttgaggtaactggaatatatcatgtagcggtgaagtgcttagatatgatatagaacaccaattgcgaaggcaggttactgagccacaactgacgctgaggcacgaaagcgtggggatcaaacagg

SEQ ID NO: 2515 - DNA, 253 bp, Unknown
  Description of Unknown: bacterium polynucleotide
  Sphingobacteriia; Sphingobacteriaceae
tacggaggatccaagcgttatccggatttattggatttaaagggtgcgtaggcggcttattaagtcaggggtgaaagacggtggctcaaccatcgcagtgcccttgctactgatgagcttgaatacattagaggtaggcggaatgtgacaagtagcggtgaaatgcatagatatgtcacagaacaccgattgcgaaggcagcttactatgatgagattgacgctgaggcacgaaagcgtggggatcaaacagg

SEQ ID NO: 2516 - DNA, 253 bp, Unknown
  Description of Unknown: bacterium polynucleotide
  Sphingobacteriia; Sphingobacteriaceae
tacggaggatccgagcgttatccggatttattgggtttaaagggtgcgtaggcggcctattaagtcaggggtgaaagacggtagcttaactatcgcagtgcctttgatactgataggcttgaatgtacttgaggtaggcggaatgtgacaagtagcggtgaaatgcatagatatgtcacagaacaccaattgcgaaggcagcttgctaaagtatgattgacgctgaggcacgaaagcgtggggatcaaacagg

SEQ ID NO: 2517 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggcctattaagtcaggggtgaaagacggtagctttactatcgcagtgcccttggtactgatgggcttgaatacactagaggtaggcggaatgtgacaagtagcggtgaaatgcatagatatgtcacagaacaccaattgcgaaggcagcttactatggtgtcattgacgctgaggcacgaaagcgtggggatcaaacagg

SEQ ID NO: 2518 - DNA, 252 bp, Unknown
  Description of Unknown: bacterium polynucleotide
  Sphingobacteriia; Sphingobacteriaceae
tacgaggatccaagcgttatccggatttattgggtttaaagggtgcgtaggtggctttttaagtcaggggtgaaagacggtagcttaactatcgcagtgcctttgatactgaagagcttgaatgaactagaggtaggcggaatgtgacaagtagcggtgaaatgcatagatatgtcacagaacaccaattgcgaaggcagcttactagggttttattgacactgaggcacgaaagcgtggggagcaaacagg

SEQ ID NO: 2519 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 2520 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggttctttaagtcaggggtgaaagacggtagcttaactaccgcagtgcctttgatactgaagaacttgaatacacttgaggtaggcggaatgtgacaaatagcggtgaaatgcatagatatgtcacagaacaccaattgcgaaggcagcttactaaagtgtcattgacgctgaggcacgaaagcgtggggatcaaacagg

SEQ ID NO: 2521 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggtggcctattaagtcaggggtgaaagacggtagcttaactatcgcagtgcctttgatactgatgggcttgaatacagttgaagtaggcggaatgtgacaagtagcggtgaaatgcatagatatgtcacagaacaccgattgcgaaggcagcttactaaagtgtgattgacactgaggcacgaaagcgtggggatcaaacagg

SEQ ID NO: 2522 - DNA, 253 bp, Unknown
  Description of Unknown: bacterium polynucleotide
  Sphingobacteriia; Sphingobacteriaceae
gacgtaggatgcgagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtattattgacgctgaggcacgaaagcgtggggatcaaacagg

SEQ ID NO: 2523 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggtggcctgttaagtcaggggtgaaagacggtagcttaactatcgcagtgcccttgatactgacgggcttgaatggactagaggtaggcggaatgtgacaagtagcggtgaaatgcatagatatgtcacagaacaccgattgcgaaggcagcttactatggtccgattgacactgaggcacgaaagcgtggggatcaaacagg

SEQ ID NO: 2524 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggtggttcattaagtcaggggtgaaagacggcagcttaactgtcgcagtgcctttgatactgatgaacttgaatgaactagaggtaggcggaatgtgacaagtagcggtgaaatgcatagatatgtcacagaacaccaattgcgaaggcagcttactatggtttgattgacactaaggcacgaaagagtggggatcaaacagg

SEQ ID NO: 2525 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggtggctttttaagtcaggggtgaaagacggtagcttaactatcgcagtgcctttgatactgatgggcttgaatgtacttgaagtgggcggaatgtgacaagtagcggtgaaatgcatagatatgtcacagaacaccgattgcgaaggcagctcactaaagtatgattgacgctgaggcacgaaagcgtggggatcaaacagg

SEQ ID NO: 2526 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggtggttctttaagtcaggggtgaaagacggcagcttaactgtcgcagtgcctttgatactgaagaacttgaatacactagaggtaggcggaatgtgacaagtagcggtgaaatgcatagatatgtcacagaacaccaattgcgaaggcagcttactatggtgtcattgacactgaggcacgaaagcgtggggatcaaacagg

SEQ ID NO: 2527 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggtggcctggtaagtcaggggtgaaagacggtcgcttaacgatcgcagtgcctttgatactgccgggcttgaatgaactagaggtaggcggaatgtgacaagtagcggtgaaatgcatagatatgtcacagaacaccgattgcgaaggcagcttactatggttttattgacactgtggcacgaaagcgtggggatcaaacagg

SEQ ID NO: 2528 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggcctattaagtcaggggtgaaagacggtagcttaactatcgcagtgcctttgatactgacgggcttgaatggactagaggtaggcggaatgtgacaagtagcggtgaaatgcatagatatgtcacagaacaccaattgcgaaggcagcttactatggtttaattgacgctgaggcacgaaagcgtggggatcaaacagg

SEQ ID NO: 2529 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggtggttctttaagtcaggggtgaaagacggtagcttaactatcgcagtgcccttgatactgatgggcttgaatatacttgaggtaggcggaatgtgacaagtagcggtgaaatgcatagatatgtcacagaacaccaattgcgaaggcagcttactaaggtatgattgacgctgaggcacgaaagcgtggggatcaaacagg

SEQ ID NO: 2530 - DNA, 253 bp, Unknown
  Description of Unknown: bacterium polynucleotide
  Sphingobacteriia; Sphingobacteriaceae
tacggaggatccaagcgttatccggatttattgggcttaaagggtgcgtaggcggcctgttaagtcaggggtgaaagacggtagcttaactatcgcagtgcccttgatactgatgggcttgaatgtactagaggtaggcggaatgtgacaagtagcggtgaaatgcatagatatgtcacagaacaccaattgcgaaggcagcttactatggtatgattgacgctgagacacgaaagcgtgggtagcaaacagg

SEQ ID NO: 2531 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgatcgcgaaggcagctaacgaaactatcactgacactgatgcacgaaagcgtggggagcaaacagg

SEQ ID NO: 2532 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggtggtctattaagtcaggggtgaaagacggcagcttaactgtcgcagtgcctttgatactgatggacttgaattaactagaggtaggcggaatgtgacaagtagcggtgaaatgcatagatatgtcacagaacaccaattgcgaaggcagcttactatggttatattgacactgaggcacgaaagcgtggggatcaaacagg

SEQ ID NO: 2533 - DNA, 253 bp, Unknown
  Description of Unknown: bacterium polynucleotide
  Sphingobacteriia; Sphingobacteriaceae
tacggaggatccaagcgttatccggatttattgggtttaaagggagcgtaggcggcctattaagtcaggggtgaaagacggtggctcaaccatcgcagtgcctttgatactgatgggcttgaatatagttgaggtaggcggaatgtgacaagtagcggtgaaatgcatagatatgtcacagaacaccgattgcgaaggcagcttactaagctatgattgacgctgaggctcgaaagcgtggggatcaaacagg

SEQ ID NO: 2534 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggcctgttaagtcaggggtgaaagacggtagcttcactatcgcagtgcccttgatactgatgggcttgaatggactagaggtaggcggaatgtgacaagtagcggtgaaatgcatagatatgtcacaggacgccaattgcgaaggcagcttactatggtatgattgacgctgaggcacgaaagcgtggggatcaaacagg

SEQ ID NO: 2535 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggcctgttaagtcaggggtgaaagacggtagctcaactatcgcagtgcctttgatactgcagggcttgaatgtacttgaggtaggcggaatgtgacaagtagcggtgaaatgcatagatatgtcacagaacaccaattgcgaaggcagcttactaaggtatgattggcgctgaggcacgaaagcgtggggagcaaacagg

SEQ ID NO: 2536 - DNA, 253 bp, Unknown
  Description of Unknown: bacterium polynucleotide
  Sphingobacteriia; Sphingobacteriaceae
tacggaggatccgagcgttatccggatttattgggtttaaagggtgcgtaggcggcctattaagtcaggggtgaaagacggtagctcaactatcgcagtgcctttgatactgatgggcttgaatgcagctgaggtaggcggaatgtgacaagtagcggtgaaatgcatagatatgtcacagaacaccgattgcgaaggcagcttactaaagtgcgattgacgctgaggcacgaaagcgtggggatcaaacagg

SEQ ID NO: 2537 - DNA, 253 bp, Unknown
  Description of Unknown: bacterium polynucleotide
  Sphingobacteriia; Sphingobacteriaceae
tacggaggatccgagcgttatccggatttattgggtttaaagggagcgtaggcggcccgttaagtcaggggtgaaagacggtggctcaaccatcgcagtgcctttgatactgacgggcttgaatacacttgaggtaggcggaatgtgacaagtagcggtgaaatgcatagatatgtcacagaacaccgattgcgaaggcagcttactaaagtgtgattgacgctgaggctcgaaagcgtggggatcaaacagg

SEQ ID NO: 2538 - DNA, 253 bp, Unknown
  Description of Unknown: bacterium polynucleotide
  Sphingobacteriia; Sphingobacteriaceae
tacggaggatccgagcgttatccggatttattgggtttaaagggtgcgtaggcggccttgtaagtcaggggtgaaagacggtagctcaactatcgcagtgcctttgatactgcagggcttgaatgtacttgaagtaggcggaatgtgacaagtagcggtgaaatgcatagatatgtcacagaacaccgattgcgaaggcagcttactaaagtatgattgacgctgaggcacgaaagcgtggggatcaaacagg

SEQ ID NO: 2539 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggcctattaagtcagtggtgaaagacggtagcttagctatcgcagtgcctttgatactgatgggcttgaacgtactagaagtaggcggaatgtgacaagtagcggtgaaatgcatagatatgtcacagaacaccgattgcgaaggcagcttactatggtatgattgacgctgaggcacgaaagcgtggggatcaaacagg

SEQ ID NO: 2540 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggctttttaagtcaggggtgaaagacggtggctcaaccatcgcagtgcctttgatactgaagagctggattaaacttgaggtaggcggaatgtgacaagtagcggtgaaatgcatagatatgtcacagaacaccgattgcgaaggcagcttactaaggttttaatgacgctgaggcacgaaagcgtggggatcaaacagg

SEQ ID NO: 2541 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggctcattaagtcaggggtgaaagacggtagcttaactatcgcagtgcctttgatactgatgagcttgaatgtagttgaggcaggcggaatgtgacaagtagcggtgaaatgcatagatatgtcacagaacaccaattgcgaaggcagcttgctaaactatgattgacgctgaggcacgaaagcgtggggatcaaacagg

SEQ ID NO: 2542 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggcctgttaagtcaggtgtgaaagacggtggctcaaccatcgcagtgcctttgatactgacgggcttgaatgcagctgaggtaggcggaatgtgacaagtagcggtgaaatgcatagatatgtcacagaacaccaattgcgaaggcagcttactaaagtgtgattgacgctgaggcacgaaagcgtggggatcaaacagg

SEQ ID NO: 2543 - DNA, 253 bp, Unknown
  Description of Unknown: bacterium polynucleotide
  Sphingobacteriia; Sphingobacteriaceae
tacggaggatccaagcgttatccggatttattgggtttaaagggtgcgtaggcggctctttaagtcaggggtgaaagacggtggcttaaccatcgcagtgcccttgatactgaagagcttgaatagacctgaggtaggcggaatgtgacaagtagcggtgaaatgcatagatatgtcacagaacaccaattgcgaaggcagcttactaaagtcttattgacgctgaggcacgaaagcgtggggatcaaacagg

SEQ ID NO: 2544 - DNA, 253 bp, Mucilaginibacter ximonensis
  Sphingobacteriia; Sphingobacteriaceae; Mucilaginibacter ximonensis
tacggaggatccaagcgttatccggatttattgggtttaaagggtgcgtaggtggcctgttaagtcaggggtgaaggacggtagctcaactatcgcagtgcccttgatactgatgggcttgaatgaactagaggtaggcggaatgtgacaagtagcggtgaaatgcatagatatgtcacagaacaccaattgcgaaggcagctaactatggtttgattgacactgaggcacgaaagcgtggggatcaaacagg

SEQ ID NO: 2545 - DNA, 253 bp, Mucilaginibacter daejeonensis
  Sphingobacteriia; Sphingobacteriaceae; Mucilaginibacter daejeonensis
tacggaggatccaagcgttatccggatttattgggtttaaagggtgcgtaggtggcctggtaagtcaggggtgaaagacggcagcttaactgtcgcagtgcctttgatactgccgggcttgaatacagttgaagtgggcggaatgtgacaagtagcggtgaaatgcatagatatgtcacagaacaccgatcgcgaaggcagctcactaaagtgtgattgacactgaggcacgaaagcgtggggatcaaacagg

SEQ ID NO: 2546 - DNA, 253 bp, Olivibacter sp.
  Sphingobacteriia; Sphingobacteriaceae; Olivibacter
tacggaggatccgagcgttatccggaattattgggtttaaagggtgcgcaggcggggatctaagtcaggggtgaaagacggtggctcaaccatcgcagtgcctttgatactggattccttgaatgtacctgaggtaggcggaatgtggcaagtagcggtgaaatgcatagatatgccacagaacaccgattgcgaaggcagcttaccaaagtatgattgacgctgaggcacgaaagcgtggggatcgaacagg

SEQ ID NO: 2547 - DNA, 253 bp, Pedobacter sp.
  Sphingobacteriia; Sphingobacteriaceae; Pedobacter
tacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacagg

SEQ ID NO: 2548 - DNA, 253 bp, Pedobacter sp.
  Sphingobacteriia; Sphingobacteriaceae; Pedobacter
tacggaggatccaagcgttatccggatttattgggtttaaagggtgcgtaggcggcttattaagtcaggggtgaaagacggtggctcaaccatcgcagtgcccttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 2549 - DNA, 253 bp, Pedobacter sp.
  Sphingobacteriia; Sphingobacteriaceae; Pedobacter
tacggaggatccaagcgttatccggatttattgggtttaaagggtgcgtaggcggcctgttaagtcagaggtgaaagacggtagctcaactatcgcagtgcctttgatactgacgggcttgaataaactagaggtaggcggaatgagacaagtagcggtggaatgcatagatatgtctcagaacaccgattgcggaggcagcttactatggttttattgacgctgaggcacgaaagcgtggggatcaaacagg

SEQ ID NO: 2550 - DNA, 253 bp, Pedobacter sp.
  Sphingobacteriia; Sphingobacteriaceae; Pedobacter
tacgtaggatccaagcgttatccggatttattgggtttaaagggtgcgtaggcggcctgttaagtcaggggtgaaagacggtagctcaaccatcgcagtgcccttgatactgacgggcttgaatgaactagaggtaggcggaatgtgacaagtagcggtgagatgcatagatatgtcacagaacaccgattgcgaaggcagcttactagggttttattgacgctgaggcacgaaagcgtggggatcaaacagg

SEQ ID NO: 2551 - DNA, 253 bp, Pedobacter sp.
  Sphingobacteriia; Sphingobacteriaceae; Pedobacter
tacgaagggggctagcgttgtccggatttattgggtttaaagggtgcgtaggcggcctgttaagtcaggggtgaaagacggtagctcaactatcgcagtgcccttgatactgatgggcttgagtggactagaggtaggcggaatgagacaagtagcggtgaaatgcatagatatgtctcagaacaccgattgcgaaggcagcttactatggtcttattgacgctgaggcacgaaagcgtggggatcaaacagc

SEQ ID NO: 2552 - DNA, 253 bp, Pedobacter sp.
  Sphingobacteriia; Sphingobacteriaceae; Pedobacter
tacggaggatccaagcgttatccgggtttattgggtttaaagggtgcgtaggcggcctgttaagtcaggggtgaaagacggtagctcaactatcgcagtgcccttgatactgacgggcttgaattgactagaggtaggcggagtgtgacaagtagcggtgaaatgcgtagatatgtcacagaacaccgattgcgaaggcagcttactatggtcatattgacgctgaggcacgaaagcgtggggatcaaacagg

SEQ ID NO: 2553 - DNA, 253 bp, Pedobacter sp.
  Sphingobacteriia; Sphingobacteriaceae; Pedobacter
tacggaggatccaagcgttatccggatctattgggtttaaagggtgcgtaggcggcctattaagtcaggggtgaaagacggtggctcaaccatcgcagtgcctttgatactgatgggcttgaatgaactagaggtaggcggaatgtgacaagtagcggtgaaatgcatagatatgtcacagaacaccgattgcgaaggcagcttactatggtttaattgacgctgaggcacgaaagcgtggggatcgaacagg

SEQ ID NO: 2554 - DNA, 253 bp, Pedobacter sp.
  Sphingobacteriia; Sphingobacteriaceae; Pedobacter
tacggaggatccaagcgttatccggatttattgggtttaaagggtgcgtaggcggcctgttaagtcaggggtgagagacggtggctcaaccatcgcagtgcccttgatactgatgagcttgaatacactagaggtaggcggaatgtgacaagtagcggtgaaatgcatagatatgtcacagaacaccgattgcgaaggcggcttactagggtgtgattgacgctgaggcacgaaagcgtggggatcaaacagg

SEQ ID NO: 2555 - DNA, 253 bp, Pedobacter sp.
  Sphingobacteriia; Sphingobacteriaceae; Pedobacter
tacgtagggcgcaagcgttatccggatttattgggtttaaagggtgcgtaggcggcttattaagtcaggggtgaaagacggtggctcaaccattgcagtgcctttgatactgatgagcttgaatgaactagaggcaggcggaatgtgacaagtagcggtgaaatgcatagatatgtcacagaacaccgattgcgaaggcagcttactatggttttattgacgctgaggcacgaaagcgtggggatcaatcagg

SEQ ID NO: 2556 - DNA, 253 bp, Sphingobacterium faecium
  Sphingobacteriia; Sphingobacteriaceae; Sphingobacterium faecium
tacggaggatccaagcgttatccggatttattgggtttaaagggtgcgtaggcggtcctataagtcagtggtgaaagacggcagcttaactgtcgcagtgcctttgatactgtaggacttgaatctatttgaagtgggcggaataagacaagtagcggtgaaatgcatagatatgtcttagaactccgattgcgaaggcagctcactaagttagtattgacgctgatgcacgaaagcgtggggatcaaacagg

SEQ ID NO: 2557 - DNA, 253 bp, Sphingobacterium sp.
  Sphingobacteriia; Sphingobacteriaceae; Sphingobacterium
tacggaggatccgagcgttatccggatttattgggtttaaagggtgcgtaggcggttttttaagtcaggagtgaaagacggcagctcaactgtcgcagtgctcttgatactgaagaacttgaatgccgttgaagatggcggaatgagacaagtagcggtgaaatgcatagatatgtctcagaactccgattgcgaaggcagctatctaatcggtgattgacgctgatgcacgaaagcgtggggatcgaacagg

SEQ ID NO: 2558 - DNA, 253 bp, Sphingobacterium sp.
  Sphingobacteriia; Sphingobacteriaceae; Sphingobacterium
tacggaggatccaagcgttatccggatttattgggtttaaagggtgcgtaggcggcactttaagtcaggggtgaaatacggcagcttaactgtcgcagtgcctttgatactgaagtgcttgaatgcggttgaagacggcggaatgagacaagtagcggtgaaatgcatagatatgtctcagaacaccaattgcgaaggcagctgtctaaagcgttattgacgctgatgcacgaaagcgtggggatcgaacagg

SEQ ID NO: 2559 - DNA, 253 bp, Sphingobacterium sp.
  Sphingobacteriia; Sphingobacteriaceae; Sphingobacterium
tacggaggatccgagcgttatccggatttattgggtttaaagggtgcgtaggcggcttattaagtcaggggtgaaagacggcagctcaactgtcgcagtgcctttgatactgatgagcttgaatgtgattgaagatggcggaatgagacaagtagcggtgaaatgcatagatatgtctcagaactccaattgcgaaggcagctatctaagtcatgattgacgctgatgcacgaaagcgtggggatcgaacagg

SEQ ID NO: 2560 - DNA, 253 bp, Sphingobacterium sp.
  Sphingobacteriia; Sphingobacteriaceae; Sphingobacterium
tacggaggatccgagcgttatccggaattattgggtttaaagggtgcgtaggcggccagataagtcaggggtgaaagtcggcagctcaactgtcgcagtgcctttgatactgtttggcttgaattcggttgaagatggcggaatgagacaagtagcggtgaaatgcatagatatgtctcagaacaccgattgcgaaggcagctatctaagccgttattgacgctgatgcacgaaagcgtgggtagcaaacagg

SEQ ID NO: 2561 - DNA, 253 bp, Unknown
  Description of Unknown: bacterium polynucleotide
  Spirochaetes; Spirochaetaceae
cacgtatggggcgagcgttgttcggaattattgggcgtaaagggtatgcaggcggtttcgtaagtctggtgtgtaagaccacagcttaactgggggaacgcattggaaactgcgaggcttgagtacaggagggggagctggaattccaggtgtaggggtgaaatctgtagatatctggaagaacatcagtggcgaaggcgagctcctggccatgtactgacgctgagatacgaaagcgtggggagcgaacagg

SEQ ID NO: 2562 - DNA, 253 bp, Spirochaeta aurantia
  Spirochaetes; Spirochaetaceae; Spirochaeta aurantia
cacgtaaggggcgagcgttgttcggaattattgggcgtaaagggcacgcaggcggttatacaagtccgatgtgaaagacctgggcttaactcaggggccgcgttggaaactgtatgactagagtattagagggggagtcggaattcctagtgtaggggtgaaatctgttgatattaggaagaacaccggtggcgaaggcggactcctggctggatactgacgctgaggtgcgaaagcatagggagcaaacagg

SEQ ID NO: 2563 - DNA, 253 bp, Treponema sp.
  Spirochaetes; Spirochaetaceae; Treponema
cacgtaaggggcgagcgttgttcggaattattgggcgtaaagggcgcgtaggcggtcctgtaagcccggcgtgaaaacctggagctcaactccgggcctgcgctgggaactgcgggactagagtcatggaagggaagttggaattccaggtgtaggggtgaaatctgtagatatctggaagaacaccggtggcgaaggcgaacttctggccaatgactgacgctgaggcgcgaaagtgcggggagcaaacagg

SEQ ID NO: 2564 - DNA, 253 bp, Treponema sp.
  Spirochaetes; Spirochaetaceae; Treponema
cacgtaaggggcgagcgttgttcggaattattgggcgtaaagggcatgcaggcggttgtgtaagcctgatgtgaaatcctgaggcttaacctcagaatagcattgggtactgcacgacttgaattacggaagggaaactggaattccaagtgtaggggtggaatctgtagatatttggaagaacaccggtggcgaaggcgggtttctggccgataattgacgctcagatgcgaaagtgtggggatcgaacagg

SEQ ID NO: 2565 - DNA, 253 bp, Unknown
  Description of Unknown: bacterium polynucleotide
  Sva0725
tacggagggggcgagcgttattcggaattattgggcgtaaagggcgcgtaggcggcccggtaagtcaaaggtgaaatccctcagctcaactgaggaactgcctttgaaactgtcgggcttgaggccgggagggggtagcggaattcccagtgtagcggtgaaatgcgtagatatctgggggaacatcagtggcgaaggcggcttcctggaccaacactgacgctgaggcgcgaaagcgtggggagcaaacagg

SEQ ID NO: 2566 - DNA, 253 bp, Unknown
  Description of Unknown: bacterium polynucleotide
  Sva0725
tacggagggggcgagcgttattcggaattattgggcgtaaagggcgcgtaggcggctgaacaagtcaaaggtgaaatccctcggctcaactgaggaactgcctttgaaactgttcggcttgaggccgggagggggtagcggaattcccagtgtagcggtgaaatgcgtagatattgggaggaacaccagtggcgaaggcggctacctggaccggttctgacgctgaggcgcgaaagcgtggggagcaaacagg

SEQ ID NO: 2567 - DNA, 253 bp, Unknown
  Description of Unknown: bacterium polynucleotide
  Sva0725
tacggagggggctagcgttattcggaattattgggcgtaaagggcgcgtaggcggcccggtaagtcaaaggtgaaatccctcggctcaactgaggaactgcctttgaaactgtcgggcttgaggccgggagggggtagcggaattcccagtgtagcggtgaaatgcgtagatattgggaggaacaccggtggcgaaggcggctacctggaccggttctgacgctgatgcgcgaaagcgtgggtagcaaacagg

SEQ ID NO: 2568 - DNA, 253 bp, Unknown
  Description of Unknown: bacterium polynucleotide
  Sva0725
tacagagggtgcgagcgttgttcggaattattgggcgtaaagggcgcgtaggcggctgtacaagtcaaaggtgaaatccctcggctcaactgaggaactgcctttgaaactgtacggcttgaggccgggagggggtagcggaattcccagtgtagcggtgaaatgcgtagatactgggaggaacaccagtggcgaaggcggctacctggaccggttctgacgctgatgcgcgaaagcgtgggtagcaaacagg

SEQ ID NO: 2569 - DNA, 253 bp, Unknown
  Description of Unknown: bacterium polynucleotide
  Sva0725
tacggagggggcgagcgttattcggaatcattgggcgtaaagggcgcgtaggcggcgcgataagtcaaaggtgaaatccctcggctcaactgaggaactgcctttgaaactgtcgtgcttgaggccgggagggggtggcggaattcccagtgtagcggtgaaatgcgtagatattgggaggaacaccagtggcgaaggcggccacctggaccggttctgacgctgatgcgcgaaagcgtggggagcaaacagg

SEQ ID NO: 2570 - DNA, 253 bp, Unknown
  Description of Unknown: bacterium polynucleotide
  Synechococcophycideae
gacggaggatgcaagcgttatccggaattattgggcgtaaagcgtccgcaggtggacatacaagtctgctgtcaaagtgcagagcttaactctgtaaaggcggtggaaactgtaggtcttgagtatggtaggggtagagggaattcccggtgtagcggtgaaatgcgtagatatcgggaagaacaccagtggcgaaagcgctctactgggccataactgacactgagggacgaaagctaggggagcgaaaggg

SEQ ID NO: 2571 - DNA, 253 bp, Unknown
  Description of Unknown: bacterium polynucleotide
  Synechococcophycideae
tacggaggatgcaagcgttatccggaatgattgggcgtaaagagtccgtaggtggtagttcaagtctgtggttaaagcgtggagctcaactccataagggccatggaaactgaacaactagagtgaggtaggggtagagggaattctcggtgtagcggtgaaatgcgtagatatcgggaagaacaccggtggcgaaagcgctctactggaccttaactgacactgagggacgaaagctaggggagcgaaaggg

SEQ ID NO: 2572 - DNA, 253 bp, Unknown
  Description of Unknown: bacterium polynucleotide
  Synechococcophycideae; Pseudanabaenaceae
tacggaggatgcaagcgttatccggaattattgggcgtaaagcgtccgcaggtggttgaacaagtctgctgtcaaagcgcggagcttaactccgtacaggcggtggaaactgttgaactggagtacggtaggggtagcgggaattcccagtgtagcggtgaaatgcgtagatattgggaagaacaccagcggcgaaagcgcgctactgggcctgtactgacactgagggacgaaagctaggggagcgaaaggg

SEQ ID NO: 2573 - DNA, 253 bp, Unknown
  Description of Unknown: bacterium polynucleotide
  Synechococcophycideae; Pseudanabaenaceae
tacgggagaggcgagcgttatccggaattattgggcgtaaagcgtccgcaggtggccaattaagtctgtcgttaaatcgtggagctcaactccatacaagcgatggaaactgattggctagagtacggtaggggtagcgggaattccaggtgtagcggtgaaatgcgtagatatctggaagaacaccagcgacgaaagtgcgctactgggcctgtactgacactcatggacgaaagccaggggagcgaaaggg

SEQ ID NO: 2574 - DNA, 253 bp, Leptolyngbya frigida
  Synechococcophycideae; Pseudanabaenaceae; Leptolyngbya frigida
tacggaggatgcaagcgttatccggaattattgggcgtaaagcgtccgcaggtggttgttcaagtctgctgttaaagcgcagagcttaactctgtaacggcggtggtaactgagcgactggagtatggtaggggtagcgggaattcccagtgtagcggtgaaatgcgtagatattgggaagaacaccagcggcgaaagcgcgctactgggccattactgacactcatggacgaaagctaggggagcgaaaggg

SEQ ID NO: 2575 - DNA, 253 bp, Unknown
  Description of Unknown: bacterium polynucleotide
  TA18
tacggagggtgcgagcgttattcggattcactgggcgtaaagagcacgtaggctgtttggtaagtctgatgtgaaagccctcgacttaatcgaggaagtgcattggatactgccaaactagagtgcaggagaggaagatggaattcccggtgtagaggtgaaattcgtagatatcgggaggaacaacagaggcgaaggcgatcttctggactgtaactgacgctgaggtgcgaaagcgtgggtagcaaacagg

SEQ ID NO: 2576 - DNA, 252 bp, Unknown
  Description of Unknown: bacterium polynucleotide
  TA18
tacgtagggtgcagcgttgttcggaattattgggcgtaaagcgcgtgtaggcggtttgctaagtctggtgtgaaagcccgaggcttaacttcggaagtgcaccggatactggcaagctagaggacgagatagggaagtggaattcctggtgtaggggtgaaatccgtagatatcaggaggaacatcggtggcgaaggcgacttcctggctcgtaactgacgctgagacgcgaaagcgtgggtagcaaacagg

SEQ ID NO: 2577 - DNA, 253 bp, Unknown
  Description of Unknown: bacterium polynucleotide
  TA18
tacggagggtgcaagcgttgttcggaattattgggcgtaaagcgcgtgtaggcggctatttaagtctggtgtgaaagcccggggctcaaccccggaagtgcactggatactgggtagctagaggacgagagaggaaagtggaattcatggtgtaggggtgaaatccgtagatatcatgagtaacatctgtggcgaaggcgacgttctggctcgtttctgacgctgagacgcgaaagcgtggggagcaaacagg

SEQ ID NO: 2578 - DNA, 253 bp, Nitrosopumilus sp.
  Thaumarchaeota; Cenarchaeaceae; Nitrosopumilus
aaccagcacctcaagtggtcaggatgattattgggcctaaagcatccgtagccggctctgtaagttttcggttaaatctgtacgcttaacgtacaggctgccgggaatactgcatagctaggaagtgggagaggtagacggtactcggtaggaaggggtaaaatcctttgatctattgatgaccacctgtggcgaaggcggtctaccagaacacgttcgacggtgagggatgaaagctgggggagcaaaccgg

SEQ ID NO: 2579 - DNA, 253 bp, Candidatus nitrososphaera
  Thaumarchaeota; Nitrososphaeraceae; Candidatus Nitrososphaera
taccagcaccccgagtggtcgggacgtttattgggcctaaagcatccgtagccggttctataagtcttccgttaaatccacctgcttaacagatgggctgcggaagatactatggagctaggaggcgggagaggcaagcggtactcgatgggtgggggtaaaatccgttgatccattgaagaccaccagtggcgaaggcggcttgccagaacgcgctcgacggtgagggatgaaagctgggggagcgaacagg

SEQ ID NO: 2580 - DNA, 253 bp, Candidatus nitrososphaera
  Thaumarchaeota; Nitrososphaeraceae; Candidatus Nitrososphaera
taccagcaccccgagtggtcgggacgattattgggcctaaagcatccgtagccggtcttgcaagtcctccgttaagtccagctgcttaacagatgggccgcggaggatactacaaggctaggaggcgggagaggcaagcggtactcagtgggtaggggtaaaatcctctgatccattgaagaccaccagtggcgaaggcggcttgccagaacgcgctcgacggtgagggatgaaagctgggggagcaaaccgg

SEQ ID NO: 2581 - DNA, 253 bp, Candidatus nitrososphaera
  Thaumarchaeota; Nitrososphaeraceae; Candidatus Nitrososphaera
taccagcaccccgagtggtcgggacgattattgggcctaaagcatccgtagccggttctgcaagtcctccgttaaatccagctgctcaacagatgggccgcggaggatactacagagctaggaggcaggagaggcaagcggtactcagtgggtaggggtaaaatccgttgatccattgaagaccaccagtggcgaaggcggcttgccagaatgcgctcgacggtgagggatgaaagctgggggagcaaaccgg

SEQ ID NO: 2582 - DNA, 253 bp, Candidatus nitrososphaera
  Thaumarchaeota; Nitrososphaeraceae; Candidatus Nitrososphaera
taccagcaccccgagttgtcgggacgattattgggcctaaagcatccgtagcctgttctgcaagtcctccgttaaatccacccgcttaacggatgggctgcgggggatactgcagagctaggaggcgggagaggcaaacggtactcagtgggtaggggtaaaatccattgatctactgaagaccaccagtggcgaaggcggtttgccagaacgcgctcgacggtgagggatgaaagctgggggagcaaaccgg

SEQ ID NO: 2583 - DNA, 253 bp, Candidatus nitrososphaera
  Thaumarchaeota; Nitrososphaeraceae; Candidatus Nitrososphaera
taccagcaccccgagtggtcgggacgattattgggcctaaagcatccgtagccggtcctacaagtcttccgttaaatccacctgcttaacagatgggctgcggaagatactatagggctaggaggcgggagaggcaagcggtactcagtgggtaggggtaaaatcctctgatccactgaagaccaccagtggcgaaggcggcttgccagaacgcgctcgacggtgagggatgaaagctgggggagcaaaccgg

SEQ ID NO: 2584 - DNA, 253 bp, Candidatus nitrososphaera
  Thaumarchaeota; Nitrososphaeraceae; Candidatus Nitrososphaera
taccagcaccccgagtggtcgggacgattattgggcctaaagcatccgtagccggttatgcaagtcttccgttaaatccacctgcttaacagatgggctgcggaggatactacatggctaggaggcgggggaggcaagcggtactcagtgggtaggggtaaaatcctctgatccattgaagaccaccagtggcgaaggcggcttgccagaacgcgctcgacggtgagggatgaaagctgggggagcaaaccgg

SEQ ID NO: 2585 - DNA, 253 bp, Candidatus nitrososphaera
  Thaumarchaeota; Nitrososphaeraceae; Candidatus Nitrososphaera
taccagcaccccgagtggtcgggacgattattgggcctaaagcatccgtagccggttctacaagtcttccgttaaatccatctgcttaacagatgggctgcggaggatactatggagctaggaggcgggagaggcaagcggtacttagtgggtaggggtaaaatccgttgatccactgaagaccaccagtggcgaaggcggcttgccagaacgcgctcgacggtgagggatgaaagctgggggagcaaaccgg

SEQ ID NO: 2586 - DNA, 253 bp, Candidatus nitrososphaera
  Thaumarchaeota; Nitrososphaeraceae; Candidatus Nitrososphaera
taccagcaccccgagtggtcgggacgattattgggcctaaagcatccgtagccggtactgcaagtcttccgttaaatccacctgcttaacagttgggctgcgggggatactacagcgctaggaggcgggagaggcaagcggtactcaatgggtaggggtaaaatccgctgatccattgaagaccaccagtggcgaaggcggcttgccagaacgcgctcgacggtgagggatgaaagctgggggagcaaaccgg

SEQ ID NO: 2587 - DNA, 253 bp, Candidatus nitrososphaera
  Thaumarchaeota; Nitrososphaeraceae; Candidatus Nitrososphaera
taccagcaccccgagtggtcgggacgattattgggcctaaagcatccgtagccggtcctacaagtcttccgttaaatccagctgcttaacagatgggccgcgggagatactacagggctaggaggcgggagaggcaagcggtactttatgggtaggggtaaaatccgctgatccatagaagaccaccagtggcgaaggcggcttgccagaacgcgctcgacggtgagggatgaaagctgggggagcaaaccgg

SEQ ID NO: 2588 - DNA, 253 bp, Candidatus nitrososphaera
  Thaumarchaeota; Nitrososphaeraceae; Candidatus Nitrososphaera
taccagcaccccgagtggtcgggacgattattgggcctaaagcatccgtagccggtcctgcaagtcttccgttaaatccagctgctcaacagatgggctgcgggggatactacatggctaggaggcgggagaggcaagcggtactttatgggtaggggtagaatccgttgatccatagaagaccaccagtggcgaaggcggctggccagaacgcgctcgacggtgagggatgaaagctgggggagcaaaccgg

SEQ ID NO: 2589 - DNA, 253 bp, Candidatus nitrososphaera
  Thaumarchaeota; Nitrososphaeraceae; Candidatus Nitrososphaera
taccagcaccccgagtggtcgggacgtttattgggcctaaagcatccgtagccggttctacaagtcttccgttaaatccaactgcttaacaggtgggctgcggaagatactatagatctaggaggcgggagaggcaagcggtactcgatgggtaggggtaaaatccgttgatccattgaagaccaccagtggcgaaggcggcttgccagaacgcgctcgacggtgagggatgaaagctgggggagcaaaccgg

SEQ ID NO: 2590 - DNA, 253 bp, Candidatus nitrososphaera
  Thaumarchaeota; Nitrososphaeraceae; Candidatus Nitrososphaera
taccaacaccccgagtggtcgggacgtttattgggcctaaagcatccgtagccggttctacaagtcttccgttaaatccacctgcttaacagatgggctgcggaggatactatagagctaggaggcgggagaggcaagcggtacttagtgggtaggggtaaaatccgttgatccattgaagaccaccagtggcgaaggcggcttgccagaacgcactcgacggtgagggatgaaagccaggggagcaaacggg

SEQ ID NO: 2591 - DNA, 253 bp, Unknown
  Description of Unknown: archaea polynucleotide
  Thaumarchaeota; SAGMA-X
taccagcacctcgagtggtcaggacgtttattgggcctaaagcatccgtagccggctttgcaagtcttcggttaaatccacctgctcaacagatgggccgctggagatactacagagctagggagtgggagaggcagacggtattcagtgggtaggggtaaaatcctctgatccattgaggaccaccagtggcgaaggcggtctgccagaacacgttcgacggtgagggatgaaagctgggggagcaaaccgg

SEQ ID NO: 2592 - DNA, 253 bp, Unknown
  Description of Unknown: bacterium polynucleotide
  Thermoleophilia
tacgtagggggcgagcgttgtccggaatcattgggcgtaaagcgcgtgtaggcggctcgataagtccggtgtgaaaccttggggctcaaccccaagcctgcactggatactgccgagctagagcccgggaggggagagcggaattcctagtgtagcggtgaaatgcgcagatattaggaagaacaccggtggcgaaggcggctctctggaacggtactgacgctgagacgcgaaagcgtggggagcgaacagg

SEQ ID NO: 2593 - DNA, 253 bp, Unknown
  Description of Unknown: bacterium polynucleotide
  Thermoleophilia
tacgtagggggcaagcgttgtccggaatcattgggcgtaaagagcgtgtaggcggtccggtgagtcggctgtgaaagtccagggctcaaccctgggatgccggtcgatactgccgggctagagttcggaagaggcgagtggaattcccggtgtagcggtgaaatgcgcagatatcgggaggaacacctatggcgaaggcagctcgctgggacgttactgacgctgagacgcgaaagcgtggggagcaaacagg

SEQ ID NO: 2594 - DNA, 253 bp, Unknown
  Description of Unknown: bacterium polynucleotide
  Thermoleophilia
tacgtagggggctagcgttgtccggaatcattgggcgtaaagagcgtgtaggcggcccggtaagtccgctgtgaaagtcaaaggctcaacctttgaatgtcagcggatactgccgggctagagtccggaagaggcgagtggaattcctggtgtagcggtggaatgcgcagatatcaggaggaacaccaacggcgaaggcagctcgctgggacggtactgacgctgagacgcgaaagcgtggggagcgaacagg

SEQ ID NO: 2595 - DNA, 253 bp, Unknown
  Description of Unknown: bacterium polynucleotide
  Thermoleophilia
tacgtagggggcaagcgttgtccggaatcattgggcgtaaggagcgcgtaggcggtccggtaagtccgctctgaaagtccggggctcaaccccgggaggcgggcggatactgtcgggctagagtccggaagaggcgagtggaattcctggtgtagcggtgaaatgcgcagatatcaggaggaacaccaatggcgaaggcagctcgctgggacggtactgacgctgaggcgcgaaagcgtggggagcaaacagg

SEQ ID NO: 2596 - DNA, 253 bp, Unknown
  Description of Unknown: bacterium polynucleotide
  Thermoleophilia
tacgtagggagcaagcgttgtccggaatcattgggcgtaaagcgcgcgtaggtggcttcgtaagtccgttgtgaaagtcaaaggctcaacctttgaatgccgatggatactgcggagctagagtacggaagaggcgagtggaattcctggtgtagcggtggaatgcgcagatatcaggaggaacaccaatagcgaaggcagctcgctgggacgttactgacactaaggcgcgaaagcgtggggagcgaacagg

SEQ ID NO: 2597 - DNA, 253 bp, Unknown
  Description of Unknown: bacterium polynucleotide
  Thermoleophilia
tacgaagggggctagcgttgtccggaatcattgggcgtaaagcgagcgtaggcggcccgataagtctgctgtgaaagtcaacggctcaaccgttgaaagccggtggatactgtcgggctagagttcggaagaggcaagtggaattcctggtgtagcggtggaatgcgcagatatcaggaggaacacccatagcgaaggcagcttgctgggacgatactgacgctaaggctcgaaagcgtggggagcgaacagg

SEQ ID NO: 2598 - DNA, 253 bp, Unknown
  Description of Unknown: bacterium polynucleotide
  Thermoleophilia
tacgtagggggcaagcgttgtccggaattattgggcgtaaagagcgtgtaggcggtccggttagtcggctgtgaaagtcaagggctcgacccttgaatgccggtcgatactgccggactagagttcggaagaggcgagtggaattcccggtgtagcggtgaaatgcgcagatatcgggaggaacacctatggcgaaggcagctcgctgggacgatactgacgctgagacgcgaaagcgtggggagcaaacagg

SEQ ID NO: 2599 - DNA, 253 bp, Unknown
  Description of Unknown: bacterium polynucleotide
  Thermoleophilia
tacgtagggtgcaagcgttgtccggaatcattgggcgtaaagcgcgcgtaggtggtcatgtaagtccgctgtgaaagtcaaaggctcaacctttgaaagccggtggatactgcatgactagagtacggaagaggcgagtggaattcctggtgtagcggtggaatgcgcagatatcaggaggaacaccaatagcgaaggcagctcgctgggacgttactgacactgaggcgcgaaagcgtggggagcgaacagg

SEQ ID NO: 2600 - DNA, 253 bp, Unknown
  Description of Unknown: bacterium polynucleotide
  Thermoleophilia
tacgtagggggcaagcgttgtccggaatcattgggcgtaaagcgcgcgtaggcggccctgtaagtccgttgtgaaagtcaaaggctcaacctttgaatgccgatggatactgcagggctagagtccggaagaggcgagtggaattcctggtgtagcggtggaatgcgcagatatcaggaggaacaccaatagcgaaggcagctcgctgggacggtactgacgctaaggcgcgaaagcgtggggagcgaacagg

SEQ ID NO: 2601 - DNA, 253 bp, Unknown
  Description of Unknown: bacterium polynucleotide
  Thermoleophilia
tacgtagggagcaagcgttgtccggaatcattgggcgtaaagcgcgtgtaggcggttacataagtctgttgtgaaagtcggaggctcaaccttcgaaagccgatggatactgtgtgacttgagtacggaagaggagagtggaattcctggtgtagcggtgaaatgcgcagatatcaggaggaacaccaacggcgaaggcagctctctgggacgttactgacgctgagacgcgaaagcgtggggagcaaacagg

SEQ ID NO: 2602 - DNA, 253 bp, Unknown
  Description of Unknown: bacterium polynucleotide
  Thermoleophilia
tacgtagggggctagcgttgtccggaatcattgggcgtaaagcgcgcgtaggcggcctcgtaagtctgctgtgaaagtcaagggctcaacccttggatgccggtggatactgcgaggctagagtccggaagaggcgagtggaattcctggtgtagcggtggaatgcgcagatatcaggaggaacaccgacggcgaaggcagctcgctgggacggtactgacgctgaggcgcgaaagcgtggggagcgaacagg

SEQ ID NO: 2603 - DNA, 253 bp, Unknown
  Description of Unknown: bacterium polynucleotide
  Thermoleophilia
tacgtagggagcgagcgttgtccggaatcattgggcgtaaagagcatgtaggtggatcaataagtctgctgtgaaagtcgaaggctcaaccttcgaaagccggtggatactgttgatctagagtacggaagaggcgagtggaattcctggtgtagcggtggaatgcgcagatatcaggaggaacaccaatagcgaaggcagctcgctgggacgtaactgacactgagatgcgaaagcgtggggagcaaacagg

SEQ ID NO: 2604 - DNA, 253 bp, Unknown
  Description of Unknown: bacterium polynucleotide
  Thermoleophilia
tacgtagggggcaagcgttgtccggaaccattgggcgtaaagcgcgtgtaggcggttcggtaagtcggctgtgaaagtccagggcttaaccctgggatgccggtcgatactgccggactagagtccggaagaggcgagtggaattcccggtgtagcggtgaaatgcgcagatatcgggaggaacaccaatggcgaaggcagctcgctgggacggtactgacgctgagacgcggaagcgtggggagcaaacagg

SEQ ID NO: 2605 - DNA, 253 bp, Unknown
  Description of Unknown: bacterium polynucleotide
  Thermoleophilia
tacgtagggggcaagcgttgttcggaatcattgggcgtaaagagcatgtaggtggatcaattagtctgctgtgaaagtcaaaggctcaacctttgagagccggtggctactgttggtctagagtacggaagaggcgagtggaattcctggtgtagcggtggaatgcgcagatatcaggaggaacaccaatagcgaaggcagctcgctgggacgtaactgacactgagatgcgaaagcgtggggagcaaacagg

SEQ ID NO: 2606 - DNA, 253 bp, Unknown
  Description of Unknown: bacterium polynucleotide
  Thermoleophilia
tacgtagggggcaagcgttgtccggaatcattgggcgtaaagcgcgtgtaggcggtccggtaagtcggttgtgaaagcccagggctcaaccctgggatgccgaccgatactgtcggactagagttcggaagaggcgagtggaattcccggtgtagcggtgaaatgcgcagatatcgggaggaacaccaatggcgaaggcagctcgctgggacgttactgacgctgagacgcgaaagcgtggggagcaaacagg

SEQ ID NO: 2607 - DNA, 253 bp, Unknown
  Description of Unknown: bacterium polynucleotide
  Thermoleophilia
tacgtagggcgcaagcgttatccggaatcattgggcgtaaagcgcgcgtaggcggcccggtaagtccgctctgaaagtccagggctcaaccctggaaagcgggtggatactgccgggctagaatccggaagaggcgagtggaattcccggtgtagcggtgaaatgcgcagatatcgggaggaacacctatggcgaaggcagctcgctgggacggtactgacgctgagacgcgaaagcgtggggagcaaacagg

SEQ ID NO: 2608 - DNA, 253 bp, Unknown
  Description of Unknown: bacterium polynucleotide
  Thermoleophilia
tacgtagggggcaagcgttgtccggaatcattgggcgtaaagagcgtgtaggcggcctgataagtcggctgtgaaagtcaagggctcaacccttgaatgccggccgatactgtcaggctagaatccggaagaggcgagtggaatccctggtgtagcggtgaaatgcgcagatatcaggaggaacacctatggcgaaggcagctcgctgggacggtattgacgctgagacgcgaaagcgtggggagcgaacagg

SEQ ID NO: 2609 - DNA, 253 bp, Unknown
  Description of Unknown: bacterium polynucleotide
  Thermoleophilia
tacgtagggtgcaagcgttgtccggaatcattgggcgtaaagcgcgcgtaggcggcccgataagtccgctgtaaaagtcaacggctcaactgttgaaagccggtggatactgtcgggctagagtacggaagaggcaagtggaattcctggtgtagcggtggaatgcgcagatatcaggaggagcacctatagcgaaggcagcttgctgggacgttactgacgctaaggcgcgaaagcgtggggagcgaacagg

SEQ ID NO: 2610 - DNA, 253 bp, Unknown
  Description of Unknown: bacterium polynucleotide
  Thermoleophilia; Conexibacteraceae
tacgtagggggcaagcgttgttcggaatcattgggcgtaaagagcgtgtaggcggcccgataagtccgccgtgaaagtccagggctcaaccctggaatgccggtggatactgtcgggctcgagtccggaagaggtgagtggaattcctggtgtagcggtgaaatgcgcagatatcaggaggaacaccaatggcgaaggcagctcactgggacggtactgacgctgagacgcgaaagcgtggggagcaaacagg

SEQ ID NO: 2611 - DNA, 253 bp, Unknown
  Description of Unknown: bacterium polynucleotide
  Thermoleophilia; Gaiellaceae
tacgtagggggctagcgttgtccggatttactgggcgtaaagagcgtgtaggcggccaggtaggtctgctgtgaaaactcgaggctcaacctcgagacgtcggcggaaaccatctggctagagtccggaagaggagagtggaattcctggtgtagcggtgaaatgcgcagatatcaggaagaacacccgtggcgaaggcggctctctgggacggtactgacgctgagacgcgaaagcgtggggagcgaacagg

SEQ ID NO: 2612 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggcttggcaagtccgctgtgaaaactcgaggcttaacctcgagacgtcggtggaaactgcctcgctagagtccggaagaggagaatggaattcctggtgtagcggtgaaatgcgcagatatcaggaagaacacccgtggctaaggcggttctctagtacggtactgacgctgagacgcgaaagcgtggggagcgaacagg

SEQ ID NO: 2613 - DNA, 253 bp, Unknown
  Description of Unknown: bacterium polynucleotide
  Thermoleophilia; Gaiellaceae
tacgtagggggcaagcgttgtccggattcattgggcgtaaagagcgtgtaggcggccaggtaggtccgttgtgaaaactcgaggctcaacctcgagacgtcgatggaaaccatctggctagagtccggaagaggagagtgggattcctggtgtagcggtgaaatgcgcagatatcaggaagaacacctatggcgaaggcagctctctgggacggtactgacgctgagacgcgaaagcgtggggagcgaacagg

SEQ ID NO: 2614 - DNA, 253 bp, Unknown
  Description of Unknown: bacterium polynucleotide
  Thermoleophilia; Gaiellaceae
tacgtagggggcaagcgttgtccggatttattgggcgtaaagcgcgtgtaggcggtcatacaggtccgctgtgaaaactcgaggctcaacctcgagatgtcggtggaaaccgtatgactagagtccggaagaggagagtggaattcctggtgtagcggtgaaatgcgcagatatcaggaagaacaccaatggcgaaggcagctctctgggacggtactgacgctgagacgcgaaagcgtggggagcgaacaag

SEQ ID NO: 2615 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggccagacaggtccgttgtgaaaactagaggctcaacctctagacgtcgatggaaaccgtctggctagagtccggaagaggagagtggaattcctggtgtagcggtgaaatgcgcagatatcaggaagaacacccgtggctaaggcggctctctagtacggtactgacgctgagacgcgaaagcgtggggagcgaacagg

SEQ ID NO: 2616 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggccaggtaggtgggttgtgaaaactggaggctcaaccttcagacgtcgacccaaaccccctggctagagtccggaagaggagagtggaattcctggtgtagcggtgaaatgcgcagatatcaggaagaacacccgtggcgaaggcggctctctgggacggtactgacgctgagacgcgaaagcgtggggagcgaacagg

SEQ ID NO: 2617 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggttcggtaggtccgttgtgaaaactcgaggctcaacctcgagacgccgatggaaacccccgaactagagtccggaagaggagagtggaattcccggtgtagcggtgaaatgcgcagatatcgggaagaacacccgtggctaaggcggctctctagtacggtactgacgctgagacgcgaaagcgtggggagcgaacagg

SEQ ID NO: 2618 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggccatacaggtccgttgtgaaaactcgaggctcaacctcgagaggtcgatggaaaccgtatggctagagtccggaagaggagagtggaattcctggtgtagcggtgaaatgcgcagatatcaggaagaatatccgtggcgaaggcggctctctgggacggtactgacgctgagacgcgaaagcgtggggagcgaacagg

SEQ ID NO: 2619 - DNA, 253 bp, Unknown
  Description of Unknown: bacterium polynucleotide
  Thermoleophilia; Gaiellaceae
tacggagggtgcgagcgttgtccggatttattgggcgtaaagcgcgtgtaggcgaccagataagtctgctgtgaaaactcgaggctcaacctcgagctgtcggcggaaactatttggctagagtccggaagaggaaagcggaattcctggtgtagcggtgaaatgcgcagatatcaggaagaacacccgtggcgaaggcggctttctgggacggtactgacgctgagacgcgaaagtgtggggagcgaacagg

SEQ ID NO: 2620 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggcctgaaaggtcagctgtgaaaactcggggctcaaccccgagacgtcggttgaaaccatctggctagagtccggaagaggagtgtggaattcccggtgtagcggtgaaatgcgcagatatcgggaagaacacccgtggcgaaggcggcactctgggacggtactgacgctgagacgcgaaagcgtggggagcgaacagg

SEQ ID NO: 2621 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggccattcaggtcagctgtgaaaactcgaggctcaacctcgagacgtcggttgaaaccgtttggctagagtccggaagaggagagtggaattcccggtgtagcggtgaaatgcgcagatatcgggaagaacacccgtggcgaaggcggctctctgggacggtactgacgctgagacgcgaaagcgtggggagcgaacagg

SEQ ID NO: 2622 - DNA, 253 bp, Unknown
  Description of Unknown: bacterium polynucleotide
  Thermoleophilia; Gaiellaceae
tacgtagggggctagcgttgtccggatttattgggcgtaaagagcgtgtaggcggccatgtaggtccggtgtgaaaactcgaggcttaacctcgagatgtcatcggaaaccatttggctagagtccggaagaggagagtggaattcctggtgtagcggtgaaatgcgcagatatcaggaagaacaccaatggcgaaagcagctctctgggacggtactgacgctgagacgcgaaagcgtggggagcaaacagg

SEQ ID NO: 2623 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggtttggtaggtccgctgtgaaaactcgaggctcaacctcgagacgccggtggaaaccatcaaactagagtccggaagaggagagtggaattcctggtgtagcggtgaaatgcgcagatatcaggaagaacacccgtggctaaggcggctctctagtacggtactgacgctgagacgcgaaagcgtggggagcgaacagg

SEQ ID NO: 2624 - DNA, 253 bp, Unknown
  Description of Unknown: bacterium polynucleotide
  Thermoleophilia; Gaiellaceae
tacgtagggggcaagcgttgtccggatttattgggcgtaaagagcgtgtaggcggccgcacaggtccgttgtgaaaactggaggcttaaccttcagacgtcgatggaaaccgtgcggctagagtccggaagaggagaatggaattcctggtgcagcggtgaaatgcgcagatatcaggaagaacacccgtggctaaggcggttctctagtacggtactgacgccgagacgcgaaagcgtggggagcgaacagg

SEQ ID NO: 2625 - DNA, 253 bp, Unknown
  Description of Unknown: bacterium polynucleotide
  Thermoleophilia; Gaiellaceae
tacagaggatgcaagcgttatccggaatcattgggcgtaaagagcgtgtaggcggccaggtaggtctgctgtgaaaactcgaggctcaacttcgagatgtcggtggaaaccatctggctagagtccggaagaggagagtagaattcctggtgtagcggtgaaatgcgcagatatcaggaggaatacccgtggcgaaagcggctctctaggacggtactgacgctgagacgcgaaagcgtggggagcaaacagg

SEQ ID NO: 2626 - DNA, 253 bp, Unknown
  Description of Unknown: bacterium polynucleotide
  Thermoleophilia; Gaiellaceae
tacgtagggggcgagcgttgcccggatttattgggcgtaaagagcgtgtaggcggccaggtaggtcggctgtgaaaactcgaggctcaacctcgagatgtcggccgaagccatctggctagagtccggaagaggagaatggaattcccggtgtagcggtgaaatgcgcagatatcgggaagaacacccgtggcgaaggcggttctctgggacggtactgacgctgagacgcgaaagcgtggggggcgaacagg

SEQ ID NO: 2627 - DNA, 253 bp, Unknown
  Description of Unknown: bacterium polynucleotide
  Thermoleophilia; Gaiellaceae
tacgtagggggcaagcgttgtccggattcattgggcgtaaagagcgtgtaggcggccaggtaggtcggttgtgaaaactggagtctcaaccttcagaggtcgaccgaaaccatctggctagagtccgggagaggagagtggaattcctggtgtagcggtgaaatgcgcagatatcaggaagaacacccgtggcgaaagcggctctctggaacggtactgacgctgagacgcgaaagcgtggggagcgaacagg

SEQ ID NO: 2628 - DNA, 253 bp, Unknown
  Description of Unknown: bacterium polynucleotide
  Thermoleophilia; Gaiellaceae
tacgtagggggcaagcgttgtccggaattattgggcgtaaagagcgtgtaggcggccagttaggtctgttgtgaaaactcgaggctcaacctcgggctgtcggtggaaaccaactggctagagtccggaagaggagagtggaattcctggtgtagcggtgaaatgcgcagatatcaggaggaatacccgtggcgaaagcggctctctgggacggtactgacgctgagacgcgaaagcgtggggagcaaacagg

SEQ ID NO: 2629 - DNA, 253 bp, Unknown
  Description of Unknown: bacterium polynucleotide
  Thermoleophilia; Patulibacteraceae
tacgtagggggcaagcgttgtccggaatcattgggcgtaaagcgcgtgtaggcggcttgataagtctgctctgaaagcccggggctcaaccccgggaggcgggtggatactgtcaagctcgagtccggaagaggagtgtggaattcctggtgtagcggtgaaatgcgcagatatcaggaggaacaccaatggcgaaggcagcactctgggacgtgactgacgctgagacgcgaaagcgtggggagcaaacagg

SEQ ID NO: 2630 - DNA, 253 bp, Unknown
  Description of Unknown: bacterium polynucleotide
  Thermoleophilia; Patulibacteraceae
tacgtagggggcaagcgttgtccggaatcattgggcgtaaagcgcgtgtaggcgggtcgttaagtctgctctgaaagtccaaggctcaacctcgggatgcgggtggatactggcgacctcgagtccggaagaggcgagtggaattcctggtgtagcggtgaaatgcgcagatatcaggaggaacaccaatggcgaaggcagctcgctgggacgtgactgacgctgagacgcgaaagcgtggggagcaaacagg

SEQ ID NO: 2631 - DNA, 253 bp, Unknown
  Description of Unknown: bacterium polynucleotide
  Thermoleophilia; Patulibacteraceae
tacgtagggggcaagcgttgtccggaatcattgggcgtaaagagcgtgtaggcggctcgataagtctgctgtgaaagtccagggctcaaccctgggatgccggtggatactgtcgagctcgagtccggaagaggcgagtggaattcctggtgtagcggtgaaatgcgcagatatcaggaggaacaccgatggcgaaggcagctcgctgggacggtactgacgctgagacgcgaaagcgtggggagcaaacagg

SEQ ID NO: 2632 - DNA, 253 bp, Unknown
  Description of Unknown: bacterium polynucleotide
  Thermoleophilia; Patulibacteraceae
tacgtagggggcaagcgttgtccggaatcattgggcgtaaagcgcgtgtaggcggctcggtaagtccgctctgaaagtccggggctcaaccccgggaggcgggtggatactgtcgagctcgagtccggaagaggcgagtggaattcctggtgtagcggtgaaatgcgcagatatcaggaggaacaccgatggcgaaggcagctcgctgggacgtgactgacgctgagacgcgaaagcgtggggagcaaacagg

SEQ ID NO: 2633 - DNA, 253 bp, Unknown
  Description of Unknown: bacterium polynucleotide
  Thermoleophilia; Patulibacteraceae
tacgtagggggcaagcgttgtccggaatcattgggcgtaaagcgcgtgtaggcggctggctaagtccgctctgaaagcccggggctcaaccccgggaggcgggtggatactggtcagctcgagtccggaagaggagtgtggaattcctggtgtagcggtgaaatgcgcagatatcaggaggaacaccaatggcgaaggcagcactctgggacggtactgacgctgagacgcgaaagcgtggggagcaaacagg

SEQ ID NO: 2634 - DNA, 253 bp, Patulibacter sp.
  Thermoleophilia; Patulibacteraceae; Patulibacter
tacgtagggcgcgagcgttgtccggaatcattgggcgtaaagcgcgtgtaggcggctgagtaagtctgctgtgaaagtccaaggctcaaccttggaatgtcggcggatactgctcagctggagtacgggaggggcgagtggaattcctggtgtagcggtggaatgcgcagatatcaggaggaacacctatggcgaaggcagctcgctggaacgttactgacgctgagacgcgaaagcgtggggagcaaacagg

SEQ ID NO: 2635 - DNA, 253 bp, Unknown
  Description of Unknown: bacterium polynucleotide
  Thermoleophilia; Solirubrobacteraceae
tacgtagggggcaagcgttgtccggaatcattgggcgtaaagcgcgtgtaggcggcccggtaagtccgctgtgaaagtcgggggctcaaccctcggatgccggtggatactgtcgggctagagtgcggaagaggcgagtggaattcctggtgtagcggtgaagtgcacagatatcaggaggaacaccaattgcgaaggcagctcgctgggacgttactgacgctgagacgcgaaagcgtggggagcaaacagg

SEQ ID NO: 2636 - DNA, 253 bp, Unknown
  Description of Unknown: bacterium polynucleotide
  Thermoleophilia; Solirubrobacteraceae
tacgtagggggctagcgttgtccggaatcattgggcgtaaagcgcgtgtaggcggcccggtaagtccgctgtgaaagtcgggggctcaaccctcggatgccggtggatactgtcgggctcgagtacggaagaggcgagtggaattcctggtgtagcggtgaaatgcgcagatatcaggaggaacaccagctgcgaaggcagctcgctgggacgtcactgacgctgagacgcgaaagcgtggggagcaaacagg

SEQ ID NO: 2637 - DNA, 253 bp, Unknown
  Description of Unknown: bacterium polynucleotide
  Thermoleophilia; Solirubrobacteraceae
tacgtagggggctagcgttgtccggaatcattgggcgtaaagagcgtgtaggcggcccggtaagtccgctgtgaaagtcgggggctcaaccctcgaatgccggtggatactgtcgggctagagagcggaagaggcgagtggaattcctggtgtagcggtgaaatgcgcagatatcaggaggaacaccgattgcgaaggcagctcgctgggacgtaactgacgctgagacgcgaaagcgtggggagcaaacagg

SEQ ID NO: 2638 - DNA, 253 bp, Unknown
  Description of Unknown: bacterium polynucleotide
  Thermoleophilia; Solirubrobacteraceae
tacgtagggggctagcgttgtccggaatcattgggcgtaaagcgcgtgtaggcggttcggtaagtccgctgtgaaagtcgggggctcaaccctcgaaagccggtggatactgtcgggctagagtacggaagaggcgagtggaattcctggtgtagcggtgaaatgcgcagatatcaggaggaacaccaattgcgaaggcagctcgctgggacgttactgacgctgagacgcgaaagcgtggggagcaaacagg

SEQ ID NO: 2639 - DNA, 253 bp, Unknown
  Description of Unknown: bacterium polynucleotide
  Thermoleophilia; Solirubrobacteraceae
tacgtagggggctagcgttgtccggaatcattgggcgtaaagcgcgtgtaggcggtccggtaagtccgctgtgaaagtcgggggctcaaccctcgaatgccggtggatactgtcgggctcgagtgcgggagaggcgagtggaattcctggagtagcggtgaaatgcgcagatatcaggaggaacaccgattgcgaaggcagctcgctggaacgttactgacgctgagacgcgaaagcgtggggagcaaacagg

SEQ ID NO: 2640 - DNA, 253 bp, Unknown
  Description of Unknown: bacterium polynucleotide
  Thermomicrobia
tacgtaggggccgagcgttgtccggagttactgggcgtaaagcgcgcgcaggcggctcgtcaagcctgacgtgaaagcccccggctcaaccggggagggtcgtcggggactggcgagcttgaggtcggcaggggctggtggaactccacgtgtagcggtgaaatgcgtagagatgtggaggaacaccagtggcgaaggcgaccatctggaagattactgacgctgagacgcgaaggcgtggggagcaaacagg

SEQ ID NO: 2641 - DNA, 253 bp, Unknown
  Description of Unknown: bacterium polynucleotide
  Thermomicrobia
tacgtaggggtcgagcgttgtccggagttactgggcgtaaagcgcgtgcaggtggctcattacgcccggcgtgaaagcccccggctcaaccggggagggtcgtcggggacgggtgagcttgagggtcgcaggggctggtagaattcccggtgtagtggtgaaatgcgtagagatcgggaggaatacccgtggcgaaggcggccagctgggcgacacctgacactgagacgcgaaggcgtggggagcgaacggg

SEQ ID NO: 2642 - DNA, 253 bp, Unknown
  Description of Unknown: bacterium polynucleotide
  Thermomicrobia
tacgtaggtggcaagcgttgtccggagttattgggcgtaaagcgcgtgcaggcggcggtgtcagcccgacgtgaaagcccccggcttaaccggggagggtcgtgggggacggcaccgcttgagggcgggagaggtcggtggaattcccggtgtagtggtgaaatgcgtagagatcgggaggaacacctgtggcgaaggcggccgactgggccgaccctgacgctgaggcgcgaaggcgtggggagcgaacggg

SEQ ID NO: 2643 - DNA, 253 bp, Unknown
  Description of Unknown: bacterium polynucleotide
  Thermomicrobia
tacgtaggggtcgagcgttgtccggagttactgggcgtaaagcgtgcgcaggcggctcattgcgcccggcgtgaaagcccccggctcaaccggggagggtcgtcggggacgggtgagcttgagggtatcaggggttggtggaattcccggtgtagtggtgaaatgcgtagagatcgggaggaacacccgtggcgaaggcggccaactgggatacacctgacgctgaggcacgaaggcgtggggagcgaacggg

SEQ ID NO: 2644 - DNA, 253 bp, Unknown
  Description of Unknown: bacterium polynucleotide
  Thermomicrobia
gacgtagggtgcaagcgttgtccggagttactgggcgtaaagggcgcgtaggcggctatccgcgtcgcacgtgaaagcccccggctcaaccggggagggtcgtgcgagacggggtagctggaggcagggagaggctggtggaattcccggtgtagtggtgaaatgcgtagagatcgggaggaacacctgaggcgaaggcggccagctggccctgacctgacgctgaggcgcgaaggctcggggagcgaacggg

SEQ ID NO: 2645 - DNA, 253 bp, Unknown
  Description of Unknown: bacterium polynucleotide
  Thermomicrobia
tacgtaggggtcgagcgttgtccggagttactgggcgtaaagcgcatgcaggcggctcattacgcatggcgtgaaagcccccggctcaaccggggagggtcgtcgtgaacgggtgagcttgagggtatcaggggctggtggaattcccggtgtagtggtgaaatgcgtagagatcgggaggaacacctgtggcgaaggcggccagctgggatacacctgacgctgagatgcgaaggcgtggggagcgaacggg

SEQ ID NO: 2646 - DNA, 253 bp, Unknown
  Description of Unknown: bacterium polynucleotide
  Thermomicrobia
tacgtaggggtcgagcgttgtccggagttactgggcgtaaagcgcgcgcaggcggcgcgataagaccggcgtgaaagcccccggctcaaccggggagggtcgttggtgactgtcgcgcttgaaggcagcaggggtgagtggaattcccggtgtagtggtgagatgcgtagagatcgggaggaacacccgtggcgaaggcggctcactgggctgaccttgacgctgaggcgcgaaggcgtggggagcgaacggg

SEQ ID NO: 2647 - DNA, 253 bp, Unknown
  Description of Unknown: bacterium polynucleotide
  Thermomicrobia
tacgtagggtccgagcgttgtccggaattactgggcgcaaagcgcgcgcaggcggtccacgaggtgtcacgtgaaagccccgggctcaactcgggagggtcgtggcaaaccggtggacttgaggccggtagaggtgggtggagctcctggtggagtggtgaaatgcgtggagatcaggaagaacacccgtggcgaaggcggcccactgggccggatctgacgctgaggcgcgaaggcgtggggagcaaacagg

SEQ ID NO: 2648 - DNA, 253 bp, Unknown
  Description of Unknown: bacterium polynucleotide
  Thermomicrobia
tacgtaggggccgagcgttgtccggagttactgggcgtaaagcgcgcgcaggtggctcattacgcccggcgtgaaagcccccggcctaaccggggagggtcgtcggggacgggtgagcttgagggtatcaggggctggtggaattcccggtgtagtggtgaaatgcgtagagatcgggaggaacacccgtggcgaaggcggccagctgggatacacctgacactgaggcgcgaaggcgtggggagcgaacggg

SEQ ID NO: 2649 - DNA, 253 bp, Unknown
  Description of Unknown: bacterium polynucleotide
  Thermomicrobia
tacgtagggtccgagcgttgtccggagttactgggcgtaaagcgcgcgcaggcggcggtgctggcccggcgtgaaagcccccggctcaaccggggagggtcgtcggggaccgcaccgcttgagggcggtaggggctggtggaatgcctggtgtagtggtgaaatgcgtagagatcaggcggaacacccgtggcgaaggcggccagctgggccgtccctgacgctgaggcgcgaaggcgtggggagcgaacggg

SEQ ID NO: 2650 - DNA, 253 bp, Unknown
  Description of Unknown: archaea polynucleotide
  Thermoplasmata
tacccgcagcacaagtggtggtcattattattgggcctaaagcgtccgtagctggcttgttagatgcctgggtaaatcgatgcgctcaacgtatcgaactccgggtagaccggcaagcttgggaccgggagagatgtgagctactcgaggggtaggggtaaaatcctgtaatccttcggggaggaccagtggcgaaggcgtcacattagaacggctccgacagtgagggacgaagccctggggcgcaaaccgg

SEQ ID NO: 2651 - DNA, 253 bp, Unknown
  Description of Unknown: archaea polynucleotide
  Thermoplasmata
tacccgcagctcaagtggtggtcattattattgggcctaaagcgtccgtagctggcttgttagatgcctgggtaaatcgatgcgctcaacgtatcgaactccgggtagaccggcaagcttgggaccgggagaggcatgggctactcgcggggtaggggtaaaatcctgtaatcctgcggggaggaccagtggcgaaggcgccatgctagaacggctccgacagtgagggacgaagccctggggcgcaaaccgg

SEQ ID NO: 2652 - DNA, 253 bp, Unknown
  Description of Unknown: archaea polynucleotide
  Thermoplasmata; Methanomassiliicoccaceae
tacccgcggcacaagtggtggtcattattattgggcctaaagcgtccgtagctggcctgttagatgcctgggtaaatcgatgcgctcaacgtatcgaattccgggtagaccggcaggctcgggaccgggagaggcgtgagctactcggggggtaggggtaaaatcctgtaatcctccggggaggaccagtggcgaaggcgtcacgctagaacggctccgacagtgagggacgaagccctggggcgcaaaccgg

SEQ ID NO: 2653 - DNA, 253 bp, Unknown
  Description of Unknown: bacterium polynucleotide
  TK10
tacgtagggtgcaagcgttgcccggatttattgggcgtaaagggcgcgcaggcggctcggcacgtccgttgtgaaatcgcccggctcaactgggcggggtcagcggatacggccgagctggagcaagctagggggcaatggaattcccggtgtagtggtggaatgcgtagatatcgggaggaacaccagtggcgaaggcggttgcctggagctttgctgacgctgaggcgcgaaagcgtggggagcgatccgg

SEQ ID NO: 2654 - DNA, 253 bp, Unknown
  Description of Unknown: bacterium polynucleotide
  TK10
tacgtaggtggcaagcgttgtccggattcattgggcgtaaagcgcgggcaggcggcccgctcagtcggccgtgaaagcgccgggctcaactcggcgcggtcgggcgatactggcgggctagaggctggtagagggcggtggaattccgggagtagtggtggaatgcgtagagctccggaggaacaccagtggcgaaggcggccgcctgggccagtcctgacgctgagccgcgaaagcgtggggagccaacagg

SEQ ID NO: 2655 - DNA, 253 bp, Unknown
  Description of Unknown: bacterium polynucleotide
  TK10
tacgtagagtgcgagcgttgcccggatttattgggcgtaaagggcgcgtaggcggctctgcacgttcgttgtgaaatcgcccggctcaactgggcggggtcagcggatacggcagagcttgagcaagctagggggcaatggaattcccggtgtagtggtggaatgcgtagatatcgggaggaacaccagtggcgaaggcggttgcctggggctttgctgacgctgatgcgcgaaagcgtggggagcgatccgg

SEQ ID NO: 2656 - DNA, 253 bp, Unknown
  Description of Unknown: bacterium polynucleotide
  TK10
tacgtagggggcgagcgttgtccggatttattgggcgtaaagcgcgcgcaggcggctccgagagcccggcgtgaaagcccccggctcaaccgggggaggtcgtcggggacctcggggctggaggccggcaggggcgagcggaattcccggtgtagtggtggaatgcgtagagatcgggaggaacaccagtggcgaaggcggctcgctgggccggtcctgacgctcaggcgcgaaagcgtggggagcgatccgg

SEQ ID NO: 2657 - DNA, 253 bp, Unknown
  Description of Unknown: bacterium polynucleotide
  TK10
tacgtagggggcgagcgttgtccggattcattgggcgtaaagcgcgcgcaggcggtcagcagagcccggcgtgaaagcccccggctcaaccgggggaggccgtcggggacctgctgactggaggccggcaggggcgagcggaattcccggtgtagtggtggaatgcgtagagatcgggaggaacaccggtggcgaaggcggctcgctgggccggtcctgacgctcaggcgcgaaagcgtggggagcgatccgg

SEQ ID NO: 2658 - DNA, 253 bp, Unknown
  Description of Unknown: bacterium polynucleotide
  TK10
tacgtagggggcaagcgttgtccggatttattgggcgtaaagcgcgtgtaggcggcaaggtgtgtcgtgcgtgaaatctcccggcttaactgggaggggccgtgcgaaactgcctcgcttgaggtcagaaggggaaagtggaattccgggtgtagtggtggaatacgtagatatccggaggaacaccagcggcgaaggcggctttctggtctgatactgacgctgagacgcgaaagcgtggggagcgatccgg

SEQ ID NO: 2659 - DNA, 254 bp, Unknown
  Description of Unknown: bacterium polynucleotide
  TK10; 5B-12
tacgtagggggcgagcgttgtccggatttattgggcgtaaaaggcttgtaggtggccacgccaagtcggatgtgaaatctcccggcttaactgggaggggtcattcgatactggcgggctcgaggccggtagggggaagcggaattcccggtgtagtggtggaatgcgtagatatcgggaggaacaccagtggcgaaggcggcttcttggaccggttctgacactgaggagcgaaagcgtggggagcgatccgg

SEQ ID NO: 2660 - DNA, 253 bp, Unknown
  Description of Unknown: bacterium polynucleotide
  TK10; Dolo_23
tacgtagggggcaagcgttgtccggatttattgggcgtaaagcgctcgcaggtggttcattgcgtcgtgcgtgaaagcccccggctcaactggggagtgtcgtgcgaaacgggtgaactagaggccagtagggggatgcggaattccgggtgtagtggtggaatgcgtagagatccggaggaacaccagcggcgaaggcggcatcctggactggtcctgacactcaggagcgaaagcgtgggtagcgaacagg

SEQ ID NO: 2661 - DNA, 253 bp, Unknown
  Description of Unknown: bacterium polynucleotide
  TK10; Dolo_23
tacgtagggggcaagcgttgtccggatttattgggcgtaaagcgctcgcaggtggtccgtcgcgtcgtgcgtgaaagaccccggctcaaccggggagggtcgtgcgatacgggcggactggaggccagtagggggatgcggaattccgggtgtagtggtggaatgcgtagagatccggaggaacaccagcggcgaaggcggcatcctggactggtcctgacactcaggagcgaaagcgtggggagcgttccgg

SEQ ID NO: 2662 - DNA, 253 bp, Unknown
  Description of Unknown: bacterium polynucleotide
  TK10; FFCH4570
tacgtagggtgcgagcgttgcccggatttattgggcgtaaagggcgcgcaggcggccacgcacgtccgttgtgaaatcgcccggctcaactgggcggggtcagcggatacggcgtggctggagcaagctagggggcaatggaattcccggagtagtggtggaatgcgtagatatcgggaggaacaccagtggcgaaggcggttgcctggagctttgctgacgctgaggcgcgaaagcgtggggagcgatccgg

SEQ ID NO: 2663 - DNA, 253 bp, Unknown
  Description of Unknown: bacterium polynucleotide
  TK17
tacgtaggtggcgaacgttgtccggatttactgggcgtaaagcgcgcgcaggcggaccgataagtcagaggtgaaatctcccggctcaactgggagcggccctttgatactgtcggtcttgagatgcctagaggagagtggaattcccggtgtagtggtggaatgcgtagatatcgggaggaacaccagtggcgaaagcggctctctgggggcgatctgacgctgaggcgcgaaagcgtggggagcaaaccgg

SEQ ID NO: 2664 - DNA, 254 bp, Unknown
  Description of Unknown: bacterium polynucleotide
  TM7-1
tacggaggatccaagcgttatccggaattactgggcgtaaagagttgcgtaggtggcatagtaagcgaatagtgaaagcgtgtggctcaaccatacatacattatttgaactgctaagcttgaggatgagagaggttattggagttcccagtgtaggagtgaaatccgtagatattgggaggaacaccgatggcgtaggcagataactggctcattcctgacactaaggcacgaaagcgtggggagcaaacggg

SEQ ID NO: 2665 - DNA, 255 bp, Unknown
  Description of Unknown: bacterium polynucleotide
  TM7-3
tacgtaggacccaagcgttatccggagtgactgggcgtaaagagttgcgtaggtggttagtaaagcgaatagtgaaacctggtggctcaaccatacagactattattcgaactcactaactcgagagtagcagaggtaactggaatttcttgtgtaggagtgaaatccgtagatataagaaggaacaccaatggcgtaggcaggttactgggctatttctgacactgaggcacgaaagcgtggggagcgaaccgg

SEQ ID NO: 2666 - DNA, 255 bp, Unknown
  Description of Unknown: bacterium polynucleotide
  TM7-3
tacgtagggtgcaagcattatccggagtgactgggcgtaaagagttgcgtaggtggtttgttaagtgaatagtgaaatctgggggctcaacctcacagactattattcaaactggcaaactcgagaatggtagaggtaactggaatttctagtgtaggagtgaaatccgtagatattagaaggaacaccaatggcgtaggcaggttactggaccatttctgacactgaggcacgaaagcgtggggagcgaaccgg

SEQ ID NO: 2667 - DNA, 255 bp, Unknown
  Description of Unknown: bacterium polynucleotide
  TM7-3
tacgtagggtgcaagcattatccggagtgactgggcgtaaagagttgcgtaggtggtcagtaaagtgaatagtgaaatgtggcggctcaaccgtacacactattattcagactcactgactcgagaatggtagaggtaactggaatttcttgtgtaggagtgaaatccgtagatataagaaggaacaccaatggcgtaggcaggttactggaccatttctgacactaaggcacgaaagcgtggggagcgaaccgg

SEQ ID NO: 2668 - DNA, 255 bp, Unknown
  Description of Unknown: bacterium polynucleotide
  TM7-3
tacgtaggatccaagcgttatccggagtgactgggcgtaaagagttgcgtaggtggtttgttaagtagatagtgaaatctggcggctcaaccgtacaggctattatctaaactgacaaactcgagaatggtagaggtaactggaatttcttgtgtaggagtgaaatccgtagatataagaaggaacaccaatggcgtaggcaggttactggaccatttctgacactgaggcacgaaagcgtggggagcgaaccgg

SEQ ID NO: 2669 - DNA, 255 bp, Unknown
  Description of Unknown: bacterium polynucleotide
  TM7-3
tacgtaggacccaagcgttatccggagtgactgggcgtaaagagttgcgtaggtggtttgttaagtgaatagtgaaatctggtggctcaaccatacagactattattcaaactggcaaactcgagaacagcagaggtaactggaatttctgaagtaggggtaatatccgtagatatcagaaggaacaccaatggcgtaggcaggttactgggctgtttctgacactgaggcacgaaagcgtggggagcgaaccgg

SEQ ID NO: 2670 - DNA, 253 bp, Unknown
  Description of Unknown: bacterium polynucleotide
  vadinHA49
tacatgtggggcaagcgttgttcggaattactgggcataaagggtgcgtaggtggtttgttaagtcaggggtgaaatcccgcggcccaaccgtggaactgcctttgatactggcgaacttgagtgcgtgaggggtagggggaacgagcagtgtagcggtgaaatgcgtagatattgctcggaaggccagagccgaaggggccctactggtgcgtaactgacactgaggcacgaaagcgtggggagcaaacagg

SEQ ID NO: 2671 - DNA, 254 bp, Unknown
  Description of Unknown: bacterium polynucleotide
  vadinHA49
tacatgtggggcaagcgttgttcggaatcactgggcataaagggtgcgtaggcggcatgatacgtcttgggtgaaatcctgcggcccaaccgcgggtctgcctgagatacggtcaagctggagtgcgtgaggggtgactggaacgcgtggtgtagcggtgaaatgcgtagatatcacgcggaaggccaacggcgaaggcaggtcactggcacgcaactgacgctgagtgcacgaaagcgtggggagcaaacagg

SEQ ID NO: 2672 - DNA, 253 bp, Unknown
  Description of Unknown: bacterium polynucleotide
  vadinHA49
gacagagggtgcaaacgttgttcggaattactgggcataaagggtgcgtaggcggcatgccaagtcaggggtgaaaggtttcggcccaaccgggacagtgcctttgatactggcgtgcttgagtgcgtgaggggtgactggaacgagtggtgtagcggtgaaatgcgtagatatcactcggaaggccaacggcgaaggcaggtcactggtacgcaactgacgctgaggcacgaaagcgtggggagcaaacagg

SEQ ID NO: 2673 - DNA, 252 bp, Unknown
  Description of Unknown: bacterium polynucleotide
  vadinHA49
tacgtgaggggcgaacgttgttcggtgtcactgggcttaaagggtgcgtaggtggttgcgtaagtaaggtgtgaaatccctcggcttacccggggaattgcattttatactgcgtggcttgaggactaaaggggaaaagggaactccaggtgtagcggtgaaatgcgcagatatctgggggaaggccggcggcgaaggcgcttttctggtagtacctgacactgaggcacgaaagcatggggagcaaacagg

SEQ ID NO: 2674 - DNA, 253 bp, Unknown
  Description of Unknown: bacterium polynucleotide
  vadinHA49
tacatgtggggcaagcgttgttcggaattactgggcataaagggtgcgtaggcggcttgttaagtcaggggtgaaagttttcggcccaaccggaaaattgcctttgatactggcgagcttgagtgcgtgaggggtaaccggaacgagtcgtgtagcggtgaaatgcgtagatatgactcggaaggccaacggcgaaggcaggttactggtacgcaactgacgctgaggcacgaaagcgtggggagcaaacagg

SEQ ID NO: 2675 - DNA, 253 bp, Unknown
  Description of Unknown: bacterium polynucleotide
  VC2_1_Bac22
tacggaggatccaagcgttatccggatttattgggtttaaagggtgcgtaggtgggatagtaagtcagaggtgaaagctagcagcttaactgttaaattgcctttgatactgctgttcttgagtgtagttggcgttggcggaatgtgacatgtagcggtgaaatgcgtagatatgtcacagaacactgatcgcgaaggcagctaacgaagctatcactgacactgatgcacgaaagcgtggggagcaaacagg

SEQ ID NO: 2676 - DNA, 253 bp, Unknown
  Description of Unknown: bacterium polynucleotide
  Verruco-5
tacagaggtggcaagcgttgttcggatttactgggcgtaaagggtgcgtaggcggtcttgtgtgtcgggtgtgaaatcccacggatcatccgtggaactgcattcgaaactgcagggcttgagtacaggagaggaaggtggaattctcggtgtagcggtgaaatgcgttgatatcgagaggaacgccggaggcgaaggcgaccttctggactgtaactgacgctgaggcacgaaagctaggggagcaaacagg

SEQ ID NO: 2677 - DNA, 253 bp, Unknown
  Description of Unknown: bacterium polynucleotide
  Verrucomicrobiae; Verrucomicrobiaceae
tacagaggtctcaagcgttgttcggaattactgggcgtaaagggtgcgtaggctgcgcggaaagtcagatgtgaaatccgggagctcaacttccgaattgcatccgatactcctgtgctagaggactggagaggagcttggaattctcggtgtagcagtgaaatgcgtagagatcaagaggaacactagtggcgaaggctgggctctggacagtatctgacgctgaggcacgaaggtcaggggagcaaacggg

SEQ ID NO: 2678 - DNA, 253 bp, Unknown
  Description of Unknown: bacterium polynucleotide
  Verrucomicrobiae; Verrucomicrobiaceae
tacagaggtctcaagcgttgttcggaatcactgggcgtaaagggtgcgtaggcggcatggtaagtcagatgtgaaatcccggagctcaactccggaattgcatccgatactgccatgcttgaggactggagaggagtctggaattcatggtggagcagtgaaatgcgtagatatcatgaggaacgctagtggcgtaggcgagactctggacagttcctgacgctgaggcacgaaggccaggggagcaaacggg

SEQ ID NO: 2679 - DNA, 253 bp, Unknown
  Description of Unknown: bacterium polynucleotide
  Verrucomicrobiae; Verrucomicrobiaceae
tacagaggcctcaagcgttgttcggaatcactgggcgtaaagggtgcgtaggcggcgcggaaagtcaggggtgaaatcccggagctcaactccggaactgcctttgatactcccgcgcttgagaactggaggggacatcggaattcacggtggagcagtgaaatgcgtggatatcgtgaggaacactagtggcgaaggcggatgtctggacagtatctgacgctgaggcacgaaggccaggggagcgaacggg

SEQ ID NO: 2680 - DNA, 253 bp, Unknown
  Description of Unknown: bacterium polynucleotide
  Verrucomicrobiae; Verrucomicrobiaceae
tacagaggtctcaagcgttgttcggaatcactgggcgtaaagggtgcgtaggctgcacggtaagtcagaggtgaaatcccggagctcaacttcggaattgcctccgatactgccgtgcttgaggactggagaggagattggaattcacagtggagcagtgaaatgcgtagatattgtgaggaacactagtggcgaaggcgaatctctggacagttcctgacgctgaggcacgaaggccaggggagcaaacggg

SEQ ID NO: 2681 - DNA, 253 bp, Unknown
  Description of Unknown: bacterium polynucleotide
  Verrucomicrobiae; Verrucomicrobiaceae
tacagaggtctcaagcgttgttcggaatcactgggcgtatagggagcgtaggccgcacggtaagtcagaggtgaaatcccggagctcaactccggaatggcctccgatactgccgtgctcgaggactggagaggagtctggaattcacagtggagcagtggaatgcgtagatattgtgaggaacactagtggcgaaggcgagactctggacagttcctgacgctgaggcacgaaggccgggggagcaaacggg

SEQ ID NO: 2682 - DNA, 253 bp, Luteolibacter sp.
  Verrucomicrobiae; Verrucomicrobiaceae; Luteolibacter
tacgaaggtcccaagcgttgttcggaatcactgggcgtaaagggagcgtaggcggcgtggtaagtcagatgtgaaatcccggggctcaaccccggaactgcatccgatactgccatgcttgagggttggagaggtagctggaattctcggtgtagcagtgaaatgcgtggatatcgagaggaacactcgtggcgaaggcgagctactggacaacatctgacgctgaggctcgaaggctaggggagcaaaaggg

SEQ ID NO: 2683 - DNA, 253 bp, Luteolibacter sp.
  Verrucomicrobiae; Verrucomicrobiaceae; Luteolibacter
tacgaaggtcccaagcgttgttcggaatcactgggcgtaaagggagcgtaggcggcgtggtaagtcagatgtgaaatcccggggctcaaccccggaaccgcatccgatactgccatgctagaggattggagaggtagctggaattcttggtgtagcagtgaaatgcgtagagatcaagaggaacactcgtggcgaaagcgagctactggacaattcctgacgctgaggctcgaaggctagggtagcgaaaggg

SEQ ID NO: 2684 - DNA, 253 bp, Luteolibacter sp.
  Verrucomicrobiae; Verrucomicrobiaceae; Luteolibacter
tacgaaggtcccgagcgttgttcggaatcactgggcgtaaagggagcgtaggcggcgtggtaagtcagatgtgaaatcccggggctcaaccccggaactgcatccgatactgccatgctagagcaatggagaggtagctggaattcttggtatagcagtgaaatgcgtagagatcaagaggaacactcgtggcgaaggcgagctactggacatttgctgacgctgaggctcgaaggccagggtagcgaaaggg

SEQ ID NO: 2685 - DNA, 253 bp, Luteolibacter sp.
  Verrucomicrobiae; Verrucomicrobiaceae; Luteolibacter
tacgaaggtcccgagcgttgttcggaatcactgggcgtaaagggagcgtaggcggcgcggtaagtcagatgtgaaatcccggggctcaaccccggaactgcatccgatactgccgtgctagaggattggagaggtagctggaattcttggtgtagcagtgaaatgcgtggagatcaagaggaacactcgtggcgaaagcgagctactggacaatatctgacgctgaggctcgaaggccagggtagcgaaaggg

SEQ ID NO: 2686 - DNA, 253 bp, Luteolibacter sp.
  Verrucomicrobiae; Verrucomicrobiaceae; Luteolibacter
tacgagggtcccaagcgttgttcggaatcactgggcgtaaagggagcgtaggcggcgtggtaagtcagatgtgaaatcccggggctcaaccccggaactgcatccgatactgccgtgcttgagggttggagaggtgactggaattatcggtgtagcagtgaaatgcgtggatatcgataggaacactcgtggcgaaggcgagtcactggacaacatctgacgctgaggctcgaaggctaggggagcaaaaggg

SEQ ID NO: 2687 - DNA, 253 bp, Prosthecobacter debontii
  Verrucomicrobiae; Verrucomicrobiaceae; Prosthecobacter debontii
tacagaggtctcaagcgttgttcggaatcactgggcgtaaagggtgcgtaggtggcgtggtaagtcagatgtgaaagcccggggctcaacctcggaattgcatccgatactgctatgcttgagtactggagaggtgactagaattctaggtgtagcagtgaaatgcgtagatatctagaggaataccaaaggcgtaggcaggtcactggacagttactgacactgaggcacgaaggccaggggagcgaacggg

SEQ ID NO: 2688 - DNA, 253 bp, Prosthecobacter sp.
  Verrucomicrobiae; Verrucomicrobiaceae; Prosthecobacter
tacagaggtctcaagcgttgttcggaatcactgggcgtaaagggtgcgtaggtggcgtggtaagtcagatgtgaaagcccggggctcaacctcggaattgcatccgatactaccatgctagagtactgaagaggtgactagaattctcggtgtagcagtgaaatgcgtagatatcgagaggaataccaacggcgaaggcaggtcactgggcagttactgacactgaggcacgaaggccaggggagcaaacggg

SEQ ID NO: 2689 - DNA, 253 bp, Unknown
  Description of Unknown: bacterium polynucleotide
  WCHB1-64
tacgtagggtgctagcgttatccggatttactgggcgtaaagcgtccgtcggcgtcttggtaagttttccgtttaagcctggggctcaactccagaaaagcggggaatactgccaggattgagtctgtttgggggaactagaattctcggtggaggggtgaaatccgtagatatcgagaggaataccagtcgcgaaggcgggttcctaaaacagtactgacgctcagggacgaaagtctgggtagcaaaaggg

SEQ ID NO: 2690 - DNA, 254 bp, Unknown
  Description of Unknown: bacterium polynucleotide
  WCHB1-64
tacgtggggtgcaagcattatccggatttactgggcgtaaagcgttctgtaggcggttttgtaagtatatggttaaaggcttcggctcaaccgaagagatgctgtataaactacatgactagatggttatcgggagtatcggaattcttggtggaggggtgaaatccgttgatatcaagaggaacaccaaaggcgaaggcagatacttaggtaactcatgacgctgatagacgacagctaggggagcgaaaggg

SEQ ID NO: 2691 - DNA, 253 bp, Unknown
  Description of Unknown: bacterium polynucleotide
  ZB2
tacagaggcctcaagcgttatccggaatcattgggcgtaaagggtgtcaaggcggtcatgttagtcattcgtaaaatccgggagctcaacttccggcccgcgagtgaaacggcatgactagaggttggaagaggtgcgtggaactcacggtgtaggggtgaaatccgttgatatcgtggggaacaccaaaggcgaaggcagcgcactggtccaaatctgacgctcacacacgaaagccagggtagcgaatggg

SEQ ID NO: 2692 - DNA, 253 bp, Unknown
  Description of Unknown: bacterium polynucleotide
  ZB2
tacagaggccccaagcgttatccggaatcactgggcgtaaagggtgtcaaggcggtcatgttagtcttccgtaaaatccaggagctcaacttctggcccgcgggagaaacggcatgactagaggttggaagaggtgcgtggaactcacggtgtaggggtgaaatccgttgatatcgtggggaacaccaaaggcgaaggcagcgcactggtccaaatctgacgctcacacacgaaagccagggtagcgaatggg

SEQ ID NO: 2693 - DNA, 253 bp, Unknown
  Description of Unknown: bacterium polynucleotide
  ZB2
tacagaagccccaagcattacccggaatcactgggcgtaaagggtgcgtaggcggttatattagtcgggtgttaaatcctggggctcaacctcagaatcgcattcgaaacggtataactaggagaagtgagaggtgtgcggaactcaaggtgtaggggtgaaatccgttgatatcttggggaacaccaaatgcgaaggcagcacactggcactctctcgacgctgaggcacgaaagcgtgggtagcgaatggg

SEQ ID NO: 2694 - DNA, 253 bp, Unknown
  Description of Unknown: bacterium polynucleotide
  ZB2
tacgagtgcttcaagcgttatccggaatcattgggcgtaaagggtgcgtaggcggcgatgttagtcttctgttaaatctttcggctcaaccgagagtctgcaggggaaacggcattgctagaggacgggagaggtctctggaactcatggtgtagcggtgaaatgcgttgatatcatggggaacaccaaaagcgaaggcaagagactggcccgctcctgacgctgaagcacgaaagcgtgggtcgcgaatggg

SEQ ID NO: 2695 - DNA, 255 bp, Unknown
  Description of Unknown: bacterium polynucleotide
  ZB2
tacagaggccccaagcattatccggaatcactgggcgtaaagggtgtgtaggcggtcgtgttagtccttcgtaaaagcccgcaggctcaacctgcggaatgcggtggaaacggcacgactccgaggatgcgagaggtaaagggaactcatggtgtaggggtgaaatccgttgatatcatggggaacaccgaatgcgaaggcactttactggcgcactcctgacgctgagacacgaaagcgtgggaatcgaacggg

SEQ ID NO: 2696 - DNA, 253 bp, Unknown
  Description of Unknown: bacterium polynucleotide
  ZB2
tacagaggccccaagcattacccggaatcactgggcgtaaagggtgcgtaggcggtcatattagtcgggtgttaaatcccggggctcaaccccggaatcgcgctcgaaacggtatgactaggagaagtgagaggtgtgcggaactcacggtgtaggggtaaaatccgttgatatcgtggggaacaccaaatgcgaaggcagcacactggcactctctcgacgctgaggcacgaaagcgtgggtagcgaatggg

SEQ ID NO: 2697 - DNA, 252 bp, Unknown
  Description of Unknown: bacterium polynucleotide
  ZB2
tacagaggcccaagcattatccggaatcattgggcgtaaagggtgtctaggcggtcatgttagtcgtttgtaaaatccgggggctcaacctccggcccgcgagcgaaacggcatgactagaggttggaagaggtgcgtggaactcacggtgtaggggtgaaatccgttgatatcgtggggaacaccaaaggcgaaggcagcgcactggtccaaatctgacgctcaagcacgaaagccagggtagcgaatggg

SEQ ID NO: 2698 - DNA, 151 bp, Fusarium sp.
  Sordariomycetes; Nectriaceae; Fusarium
gttggtgaaccagcggagggatcattaccgagtttacaactcccaaacccctgtgaacataccaattgttgcctcggcggatcagcccgctcccggtaaaacgggacggcccgccagaggacccctaaactctgtttctatatgtaacttc

SEQ ID NO: 2699 - DNA, 151 bp, Alternaria sp.
  Dothideomycetes; Pleosporaceae; Alternaria Alternaria sp MY_2011
gtaggtgaacctgcggagggatcattacacaaatatgaaggcgggctggaacctctcggggttacagccttgctgaattattcacccttgtcttttgcgtacttcttgtttccttggtgggttcgcccaccactaggacaaacataaacct

SEQ ID NO: 2700 - DNA, 151 bp, Cochliobolus sp.
  Dothideomycetes; Pleosporaceae; Cochliobolus
gtaggtgaacctgcggagggatcattacacaacaaaatatgaaggcctggcttcgcggccggctgaaatatttttttcacccatgtcttttgcgcacttgttgtttcctgggcgggttcgcccgccaccaggaccaaaccataaacctttt

SEQ ID NO: 2701 - DNA, 151 bp, Epicoccum nigrum
  Dothideomycetes; Pleosporaceae; Epicoccum Epicoccum nigrum
gtaggtgaacctgcggaaggatcattacctagagtttgtggacttcggtctgctacctcttacccatgtcttttgagtaccttcgtttcctcggcgggtccgcccgccggttggacaacattcaaaccctttgcagttgcaatcagcgtct

SEQ ID NO: 2702 - DNA, 151 bp, Trichoderma sp.
  Sordariomycetes; Hypocreaceae; Trichoderma
gttggtgaaccagcggagggatcattaccgagtttacaactcccaaacccaatgtgaacgttaccaaactgttgcctcggcggggtcacgccccgggtgcgtcgcagccccggaaccaggcgcccgccggaggaaccaaccaaactctttc

SEQ ID NO: 2703 - DNA, 151 bp, Aspergillus sp.
  Eurotiomycetes; Trichocomaceae; Aspergillus Aspergillus sp r130
gtaggtgaacctgcggaaggatcattaccgagtgcgggctgcctccgggcgcccaacctcccacccgtgactacctaacactgttgcttcggcggggagccctctcgggggcgagccgccggggactactgaacttcatgcctgagagtga

SEQ ID NO: 2704 - DNA, 151 bp, Ceratobasidium sp.
  Agaricomycetes; Ceratobasidiaceae; Ceratobasidium Ceratobasidium sp AG_B(o)
gtaggtgaacctgcggaaggatcattaatgaatgaatgtagagttggttgtagctggcttccctgaggcatgtgcacaccttctctttcatccacacacccctgtgcacttgtgagacggaggcgttttcctttaaccgggatggtctccg

SEQ ID NO: 2705 - DNA, 151 bp, Unknown
  Description of Unknown: fungal polynucleotide
  Agaricomycetes; Ceratobasidiaceae
gtaggtgaacctgcggaaggatcattaatgaatgagtgtagagtcggttgtagctggcttccctgaggcatgtgcacacctcctctttcatccacacacccctgtgcactcgtgagacggaggcgtattcctttaatcgggatggtctccg

SEQ ID NO: 2706 - DNA, 151 bp, Ceratobasidium sp.
  Agaricomycetes; Ceratobasidiaceae; Ceratobasidium
gtaggtgaacccgcggaaggatcattaatgaatgaatgtagagtcggttttagctggcttccctgaggcatgtgcacaccttctctttcatccacacacccctgtgcactcgtgagacggaagcgttttcctttaatcgggatggtctccg

SEQ ID NO: 2707 - DNA, 151 bp, Rhizoctonia zeae
  Agaricomycetes; Corticiaceae; Waitea Rhizoctonia zeae
gtaggtgaacctgcggaaggatcattaatgattggtggctgttgctgactagtgtttctagtatgtgcacgccacaccttcaatcccacttacacctgtgcaccttctgtaatagatctatgtggatacggagatgtgaaagtttgcgctc

SEQ ID NO: 2708 - DNA, 151 bp, Ceratobasidiaceae sp.
  Agaricomycetes; Ceratobasidiaceae; unidentified Ceratobasidiaceae sp
gtaggtgaacctgcggaaggatcattaatgaatgaatgtagagtcggttgtagctggcttcccttaggcatgtgcacaccttctctttcatccccacacccctgtgcactcgtgagacggaggcgttttcctttaatcgggatggtctccc

SEQ ID NO: 2709 - DNA, 151 bp, Unknown
  Description of Unknown: fungal polynucleotide
  Agaricomycetes
tgttcagaatcagaatgagccgcaacttcgggatgaaaatgctcacaatgacaaatctgtccacggagtgcttaatccaacttaccaagctgggttacgacgcgacgccgttcaaccagatattgaagcagaacgcaaaaagagagatgag

SEQ ID NO: 2710 - DNA, 151 bp, Unknown
  Description of Unknown: fungal polynucleotide
  Agaricomycetes; Ceratobasidiaceae
gtaggtgaacctgcggaaggatcattaatgaatgaatgtagagtcggttgtagctggcttccctgaggcatgtgcacaccttctctttcatccacacacccctgtgcactcgtgagacggaggcgtttttcttttatcgggatggtctccg

SEQ ID NO: 2711 - DNA, 151 bp, Ceratobasidiaceae sp.
  Agaricomycetes; Ceratobasidiaceae; unidentified Ceratobasidiaceae sp
gtaggtgaacctgcggaaggatcattaatgaatgtagagtcggttgtagctggcttccctgaggcatgtgcacaccttctctttcatccacacacccctgtgcactcgtgagacggaggcgttttcctttaatcgggatggtctccgtcta

SEQ ID NO: 2712 - DNA, 151 bp, Unknown
  Description of Unknown: fungal polynucleotide
  Agaricomycetes
gaccaatctgaccagcaaggaagccaagatgggaaaggtcatgcggcatacgctcggcgccagtttgaatattagacataatttatcctcaagtaaggggccgaagcccctgcaattaaaattgttgaccacctacataccaaagacgagc

SEQ ID NO: 2713 - DNA, 151 bp, Unknown
  Description of Unknown: fungal polynucleotide
  Agaricomycetes
gctgaggttgacttagttcatcagcaaacgcagaatcagcggtatggctcttctcatattggcgctactgcaaaggatatttctaatgtcgtcactgatgctgcttctggtgtggttgatatttttcatggtattgataaagctgttgccg

SEQ ID NO: 2714 - DNA, 151 bp, Ceratobasidium sp.
  Agaricomycetes; Ceratobasidiaceae; Ceratobasidium
gtaggtgaacctgcggaaggatcattaatgaatgaatgtagagtcggtcgtagctggcttccctgaggcacgtgcacaccttctcttccatccacacacccctgtgcactcgtgagacggaggcgttttcctttaatcgggatggtctccg

SEQ ID NO: 2715 - DNA, 151 bp, Unknown
  Description of Unknown: fungal polynucleotide
  Agaricomycetes
ggtttaagagcctcgatacgctcaaagtcaaaataatcagcgtgacattcagaagggtaataagaacgaaccataaaaaagcctccaagatttggaggcatgaaaacatacaattgggagggtgtcaatcctgacggttatttcctagaca

SEQ ID NO: 2716 - DNA, 151 bp, Unknown
  Description of Unknown: fungal polynucleotide
  Agaricomycetes
ttttcgtatgcagggcgttgagttcgataatggtgatatgtatgttgacggccataaggctgcttctgacgttcgtgatgagtttgtatctgttactgagaagttaatggatgaattggcacaatgctacaatgtgctcccccaacttgat

SEQ ID NO: 2717 - DNA, 151 bp, Tricholoma sp.
  Agaricomycetes; Tricholomataceae; Tricholoma
gtaggtgaacctgcggaaggatcattattgaataagcttggttgggttgttgctggctcttcggagcatgtgcacgcctaacaccaaccttttaccacctgtgcaccttttgtagacctggatatctctcgaggaaactcggttttgagga

SEQ ID NO: 2718 - DNA, 151 bp, Unknown
  Description of Unknown: fungal polynucleotide
  Agaricomycetes; Russulaceae; unidentified russuloid isolate BB1
gtaggtgaacctgcggaaggatcattagcgaagtcaagtccggacccgttggggattgtagctggcctaacggcatgtgctcgtcccttgggtacgtgaccttcactaccacaccccactgtgaaccaagcgggaggtcaaaaggcctctt

SEQ ID NO: 2719 - DNA, 151 bp, Unknown
  Description of Unknown: fungal polynucleotide
  Agaricomycetes; Atheliaceae; unidentified Atheliaceae sp
gtaggtgaacctgcggaaggatcattattgaattataaggctttgattgtgctggcctctcggggcatgtgcacgtctctgcccgttaatcccaacttacccctgtgaaccgaccgtgtgaggcgctctgtaacggagccgtctcatgctt

SEQ ID NO: 2720 - DNA, 151 bp, Ceratobasidium sp.
  Agaricomycetes; Ceratobasidiaceae; Ceratobasidium Ceratobasidium sp AG_B(o)
gtaggtgaacctgcggaaggatcattaatgaatgaatgtagagttggttgtagctggcttccctgaggcatgtgcacaccttctctctcatccacacacccctgtgcactcgtgggacggagacgttttcctttaatcgggatggtctccg

SEQ ID NO: 2721 - DNA, 151 bp, Coprinopsis sp.
  Agaricomycetes; Psathyrellaceae; Coprinopsis
gtaggtgaacctgcggaaggatcattattgaataaatctggcgtaggttgtagctggctctccggagcatgtgcacacctcgtcacctttatctttccacctgtgcacacactgtagtcctggatacctctcgctgaaaggcggatgcgga

SEQ ID NO: 2722 - DNA, 151 bp, Unknown
  Description of Unknown: fungal polynucleotide
  Agaricomycetes; Russulaceae; unidentified russuloid isolate BB1
gtgggtgaacctgcggaaggatcattagcgaagtcaagtccggatctgtagggattgcagctggcctaacggcatgtgctcgtcccttgggtctgtgaccttcactaccacaccccactgtgaaccaagcgggaggtcgaaaggcctcttg

SEQ ID NO: 2723 - DNA, 151 bp, Unknown
  Description of Unknown: fungal polynucleotide
  Agaricomycetes
gtaggtgaacctgcggaaggatcattaatgaataaacctggttgggttgttgctggtctttcgggacatgtgcacacctaccacttttattaaccacctgtgcaccctatgtagactgatgacaacatgtcgaggcaactcggattgagga

SEQ ID NO: 2724 - DNA, 151 bp, Phallus rugulosus
  Agaricomycetes; Phallaceae; Phallus Phallus rugulosus
gtaggtgaacctgcggaaggatcattgccgatttgaaaagggttctcgagactctcttccggagagcgctcgcccttctttcacgattcaaacaccccgtgcactctcgagggaacctcaccgttctctcgctttgaaaaacgccctttct

SEQ ID NO: 2725 - DNA, 151 bp, Thanatephorus sp.
  Agaricomycetes; Ceratobasidiaceae; unidentified uncultured Thanatephorus
gtaggtgaacctgcggaaggatcattattgaattaatgtagagttggttgtagctggcatttcctttaatttggggattgcatgtgcacaccttctctttcatccatacacccctgtgcacttgtgagacagattgctttttggaggggga

SEQ ID NO: 2726 - DNA, 151 bp, Rhizoctonia sp.
  Agaricomycetes; Ceratobasidiaceae; Rhizoctonia Rhizoctonia sp AG_G
gtaggtgaacctgcggaaggatcattattgaatgaatgtagagttggttgtcgctggccctttcgggggtatgtgcacgccttctctttcatccacacacacctgtgcacttgtgagacggagggctttaattagtcttccgtctattcaa

SEQ ID NO: 2727 - DNA, 151 bp, Clavulina sp.
  Agaricomycetes; Clavulinaceae; Clavulina
gtaggtgaacctgcggaaggatcattaatgaattgttgacggggtttgatgctggtatccaacttttggatgcatgtgctcgccccaacaattatcttccaaacacctgtgcacattttgagggagtttcgagttgattgccggttcggtg

SEQ ID NO: 2728 - DNA, 151 bp, Unknown
  Description of Unknown: fungal polynucleotide
  Agaricomycetes; Geastraceae; unidentified Geastraceae sp
gtaggtgaacctgcggaaggatcattacagtatgaatagagggatggtgctggcccctttgggggcatgtgcacgccttcaatttcaatccacatacacctgtgcaccacggacgagtttggactccactgtgtcattcagtgagtcgttt

SEQ ID NO: 2729 - DNA, 151 bp, Unknown
  Description of Unknown: fungal polynucleotide
  Agaricomycetes
gtaggtgaacctgcggaaggatcattattgaatgaacttggtgtggttgttgctggcccctgggggcatgtgcacacccaccatcctcatctctccccctgtgcacctcttgtagacttgggataaaactttccgaggcaactcggtctgg

SEQ ID NO: 2730 - DNA, 151 bp, Sakaguchia dacryoidea
  Cystobasidiomycetes; Incertae sedis; Sakaguchia Sakaguchia dacryoidea
gtaggtgaacctgcggaaggatcattaatgaaatgttaggacgctctttttagaggtccgaccaaatcattttacctttcacactgtgcacatcactacttttttacacccatttttaaacactacaaagtctaagaatgtaaaacagtct

SEQ ID NO: 2731 - DNA, 151 bp, Unknown
  Description of Unknown: fungal polynucleotide
  Dothideomycetes
gtaggtgaacctgcggaaggatcattacatattgagcgcggctgggatccccaagggctgctgcttgcctctggtaagcgcggcgcttgcccagtctgcgtgaatattcacccatgtcttttgcgtacttcttgtttccttggcgggttcg

SEQ ID NO: 2732 - DNA, 151 bp, Davidiella tassiana
  Dothideomycetes; Davidiellaceae; Davidiella Davidiella tassiana
gtaggtgaacctgcggagggatcattacaagaacgcccgggcttcggcctggttattcataaccctttgttgtccgactctgttgcctccggggcgaccctgccttcgggcgggggctccgggtggacacttcaaactcttgcgtaacttt

SEQ ID NO: 2733 - DNA, 151 bp, Cladosporium sp.
  Dothideomycetes; Mycosphaerellaceae; unidentified uncultured Cladosporium
gtaggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactt

SEQ ID NO: 2734 - DNA, 151 bp, Montagnulaceae sp.
  Dothideomycetes; Montagnulaceae; unidentified Montagnulaceae sp
gtaggtgaacctgcggaaggatcattaaccgttacaaacagtgtgtgctgcggcccccgaggtgaggcaacgagccttcgggaggtctggggtccgccccttcacgcgcacgcgtctgccatccttactttacgagcaccttccgttctcc

SEQ ID NO: 2735 - DNA, 151 bp, Alternaria padwickii
  Dothideomycetes; Pleosporaceae; Alternaria Alternaria padwickii
gtaggtgaacctgcggaaggatcattacacatataaactagatctcaggggaggttcgcctctttctgagatgtatgttatacccatgtcttttgcgtactacttgtttccttggtaggcttgcctgccaataggacaaaatcaaaacctt

SEQ ID NO: 2736 - DNA, 151 bp, Unknown
  Description of Unknown: fungal polynucleotide
  Dothideomycetes; Montagnulaceae; unidentified Montagnulaceae sp FF_2011
gtaggtgaacctgcggaaggatcattaaccgttacaaacagtgtgtgatgcggccgccgaggtgaatagcctctggttggtatggggttcgccccttcacgctcacgcgtctgccatccttactttacgagcaccttctgttctccctcgg

SEQ ID NO: 2737 - DNA, 151 bp, Lewia infectoria
  Dothideomycetes; Pleosporaceae; Lewia Lewia infectoria
gtaggtgaacctgcggagggatcattacacaataacaaggcgggctggacacccccagccgggcactgcttcacggcgtgcgcggctgggccggccctgctgaattattcacccgtgtcttttgcgtacttcttgtttcctgggtgggctc

SEQ ID NO: 2738 - DNA, 151 bp, Lewia infectoria
  Dothideomycetes; Pleosporaceae; Lewia Lewia infectoria
gtaggtgaacctgcggagggatcattacacaataaccaggcgggctggacaccccccgctgggcactgcttcacggcgtgcgcggcggggccggccctgctgaattattcacccgtgtcttttgcgtacttcttgtttcctgggggggctc

SEQ ID NO: 2739 - DNA, 151 bp, Ulocladium sp.
  Dothideomycetes; Pleosporaceae; Ulocladium
gtaggtgaacctgcggagggatcattacacaatatgaaagcgggctggcatccttcggggttacagccttgctgaattattcacccgtgtcttttgcgtacttcttgtttccttggtgggttcgcccaccataggacaaaccataaacctt

SEQ ID NO: 2740 - DNA, 151 bp, Lewia infectoria
  Dothideomycetes; Pleosporaceae; Lewia Lewia infectoria
gtaggtgaacctgcggagggatcattacacaatatgaatgcgggctggacaccctccagccgggcactgcttcacggcgtgcgcggctggagccggccctgctgaattattcacccgtgtcttttgcgtacttcttgtttcctgggtgggc

SEQ ID NO: 2741 - DNA, 151 bp, Phoma sp.
  Dothideomycetes; Incertae sedis; Phoma Phoma sp P48E5
gtaggtgaacctgcggaaggatcattacctagagttgtaggctttgcctgctatctcttacccatgtcttttgagtaccttacgtttcctcggtgggttcgcccaccgattggacaaatttaaaccctttgcagttgaaatcagcgtctga

SEQ ID NO: 2742 - DNA, 151 bp, Cochliobolus sp.
  Dothideomycetes; Pleosporaceae; unidentified uncultured Cochliobolus
gtaggtgaacctgcggagggatcattacacaataaaatatgaaggctgtacgcggctgtgctctcgggccagttttgcggaggctgaattatttattacccttgtcttttgcgcacttgttgtttcctgggcgggttcgcccgccaccagg

SEQ ID NO: 2743 - DNA, 151 bp, Cochliobolus australiensis
  Dothideomycetes; Pleosporaceae; Cochliobolus Cochliobolus australiensis
gtaggtgaacctgcggagggatcattacacaataacaatacgaaggccgttcgcggctggactattttattacccttgtcttttgcgcacttgttgtttcctgggcgggttcgctcgccaccaggaccaccatataaaccttttttatgca

SEQ ID NO: 2744 - DNA, 151 bp, Unknown
  Description of Unknown: fungal polynucleotide
  Dothideomycetes; Phaeosphaeriaceae; unidentified Phaeosphaeriaceae sp
gtaggtgaacctgcggaaggatcattacattcagtagcctagctacttgtttatacccttgttttttgcgtacctattgtttcctcggtgggcttgcctgccggttggacaacactataacctttttaaatcttcaatcagcgtctgaatt

SEQ ID NO: 2745 - DNA, 151 bp, Alternaria sp.
  Dothideomycetes; Pleosporaceae; Alternaria Alternaria sp
gtaggtgaacctgcggaaggatcattacacatataaagtatgcctgggaaaattcgaaagaaaagtacccaggcgtattcttatacccatgtcttttgcgtactacttgtttccttggtgggcttgcctgccattaggacacccctacaaa

SEQ ID NO: 2746 - DNA, 151 bp, Cercospora nicotianae
  Dothideomycetes; Mycosphaerellaceae; Cercospora Cercospora nicotianae
gtaggtgaacctgcggagggatcattactgagtgagggccttcgggctcgacctccaaccctttgtgaacacaacttgttgcttcgggggcgaccctgccgtttcgacggcgagcgcccccggaggccttcaaacactgcatctttgcgtc

SEQ ID NO: 2747 - DNA, 151 bp, Unknown
  Description of Unknown: fungal polynucleotide
  Dothideomycetes
gtaggtgaacctgcggagggatcattacaagtgaccccggtctaaccaccgggatgttcataaccctttgttgtccgactctgttgcctccggggcgaccctgccttccgggcgggggctccgggtgacacttcaaactcttgcgtaactt

SEQ ID NO: 2748 - DNA, 151 bp, Cladosporium sp.
  Dothideomycetes; Davidiellaceae; Cladosporium Cladosporium sp ascomyc1
gtaggtgaacctgcggagggatcattatatgacgccccaggcttgtacagctgggaacgcacaaccctttgttttccgactctgttgcctccggggcgaccctgccttcgggcgggggctccgggtggacacttcaaactcttgcgtaact

SEQ ID NO: 2749 - DNA, 151 bp, Unknown
  Description of Unknown: fungal polynucleotide
  Dothideomycetes; Pleosporaceae; unidentified Pleosporaceae P28E3
gtaggtgaacctgcggagggatcattacacaacaaaaatatgagggtgtggtttgctggcaacagcgtccgccccaagtatttttcacccatgtcttttgcgcactttttgtttcctgggcgagttcgctcgccaccaggacccaactata

SEQ ID NO: 2750 - DNA, 151 bp, Cladosporium sp.
  Dothideomycetes; Davidiellaceae; Cladosporium
gtaggtgaacctgcggagggatcattacaagtgacccccggctccggccggggatgttcataaccctttgttgtccgactctgttgcctccggggcgaccctgccttttcacgggcgggggccccgggtggacacatcaaaactcttgcgt

SEQ ID NO: 2751 - DNA, 151 bp, Unknown
  Description of Unknown: fungal polynucleotide
  Dothideomycetes
gtaggtgaacctgcggagggatcattacaagtgaccccggtctaaccaccgggatgttcataaccctttgttgtccgactctgttgcctccggggcgaccctgccttcgggcggggctccggtggacacttcaaactcttgcgtaactttg

SEQ ID NO: 2752 - DNA, 151 bp, Phaeoseptoria sp.
  Dothideomycetes; Phaeosphaeriaceae; Phaeoseptoria Phaeoseptoria sp FF_2011
gtaggtgaacctgcggaaggatcattacattcagtagcccagctacttgtttacacccttgtctttttgcgtacttatcgtttcctcggcgggcttgcctgccggttggacaactttataacctttttaaatcttcaatcagcgtctgaat

SEQ ID NO: 2753 - DNA, 151 bp, Alternaria sp.
  Dothideomycetes; Pleosporaceae; Alternaria Alternaria sp MY_2011
gtgggtgaacctgcggagggatcattacacaaatatgaaggcgggctggaacctctcggggttacagccttgctgaattattcacccttgtcttttgcgtacttcttgtttccttggtgggttcgcccaccactaggacaaacatccctct

SEQ ID NO: 2754 - DNA, 151 bp, Phoma sp.
  Dothideomycetes; Incertae sedis; Phoma
gtaggtgaacctgcggaaggatcattacctagagttgtaggctttgcctgctatctcttacccatgtcttttgagtacttacgtttcctcggcgggtccgcccgccgattggacaatttaaaccattttcagttgcaatcagcgtctgaaa

SEQ ID NO: 2755 - DNA, 151 bp, Alternaria sp.
  Dothideomycetes; Pleosporaceae; Alternaria Alternaria sp MY_2011
gtaggtgaacctgcggagggatcattacacaaatatgaaggcgggctggaacctctcggggttacagccttgctgaattattcacccttgtcttttgcgtacttcttgtttccttggtgggttcgcccaccataggacaaaccataaacct

SEQ ID NO: 2756 - DNA, 151 bp, Perisporiopsis sp.
  Dothideomycetes; Parodiopsidaceae; Perisporiopsis Perisporiopsis sp
gtaggtgaacctgcggaaggatcattaacgatttcgtagctgggcttcggccctgtctgcacccttgtcttttgcgtaccaattgtttcctcggcgggcttgcctgccgataggacattgtaaaaccacttgtaattgtaatcagcgtcag

SEQ ID NO: 2757 - DNA, 151 bp, Unknown
  Description of Unknown: fungal polynucleotide
  Dothideomycetes; Pleosporaceae
gtaggtgaacctgcggagggatcattacacaatatgaaggcgggctggacaaacccccctagctgggcactgcttcacggcggtgcgcggtttgggtggccggccctgctgaactattcacccgtgtcttttgcgtacctcttgtttcctg

SEQ ID NO: 2758 - DNA, 151 bp, Cladosporium sp.
  Dothideomycetes; Davidiellaceae; Cladosporium Cladosporium sp ascomyc1
gtaggtgaacctgcggagggatcattataagttcacccaggcttgtacagctggggactgacaaccctttgatttccgactctgttgcctccggggcgaccctgccttcgggcgggggctccgggtggacacttcaaactcttgcgtaact

SEQ ID NO: 2759 - DNA, 151 bp, Phoma rhei
  Dothideomycetes; Incertae sedis; Phoma Phoma rhei
gtaggtgaacctgcggaaggatcattacctagagttgtaggctttgcctgctatctcttacccatgtcttttgagtaccttcgtttcctcggcgggtccccccgccgattggacaacttaaaccatttgcagttgcaatcagcgtctgaaa

SEQ ID NO: 2760 - DNA, 151 bp, Unknown
  Description of Unknown: fungal polynucleotide
  Dothideomycetes; Pleosporaceae; unidentified Pleosporaceae P28E3
gtaggtgaacctgcggagggatcattacacaacaagatatgagggctgggtatctactggcaacagtgtttccgcccgagtattcttcacccatgtcttttgcgcacttttttgtttcctgggcgagttcgctcgccaccaggacccaact

SEQ ID NO: 2761 - DNA, 151 bp, Unknown
  Description of Unknown: fungal polynucleotide
  Dothideomycetes; Pleosporaceae; unidentified Pleosporaceae sp
gtaggtgaacctgcggagggatcattacacaataaacatatgaaggctgcaccgccaacaggcggcaaggctggagtattttattacccttgtcttttgcgcacttgttgtttcctgggcgggttcgcccgcctccaggaccacatgataa

SEQ ID NO: 2762 - DNA, 151 bp, Curvularia sp.
  Dothideomycetes; Pleosporaceae; Curvularia Curvularia sp P2E2
gttggtgaaccagcggagggatcattacacaataaaatacgaaggccgttcgcggctggactatttattacccttgtcttttgcgcacttgttgtttcctgggcgggttcgctcgccaccaggaccacaatataaaccttttttatgcagt

SEQ ID NO: 2763 - DNA, 151 bp, Unknown
  Description of Unknown: fungal polynucleotide
  Dothideomycetes; Phaeosphaeriaceae; unidentified Phaeosphaeriaceae sp MJ23
gtaggtgaacctgcggaaggatcattaaattcagtagcttgctactgttaggggggtctattagtctgtatagtatcactactgatgagcagcacgaccctctgtctatacccttgtcttttgcgcactcatgtttcctcggcggcttaat

SEQ ID NO: 2764 - DNA, 151 bp, Dendryphiella arenaria
  Dothideomycetes; Pleosporaceae; Dendryphiella Dendryphiella arenaria
gtaggtgaacctgcggagggatcattacacaatatgaaagcgggttgggacctcacctcggtgagggctccagcttgtctgaattattcacccatgtcttttgcgcacttcttgtttcctgggcgggttcgcccgccaccaggaccaaacc

SEQ ID NO: 2765 - DNA, 151 bp, Alternaria sp.
  Dothideomycetes; Pleosporaceae; Alternaria Alternaria sp MY_2011
gtaggtgaacctgcggagggatcattacacaaatatgaaggcgggctggaacctctcggggttacagccttgctgaattattcacccttgtcttttgcgtacttcttgtttcctgggtgggctcgcccgccatcaggaccaaccacaaacc

SEQ ID NO: 2766 - DNA, 151 bp, Davidiella sp.
  Dothideomycetes; Davidiellaceae; Davidiella
gtaggtgaacctgcggagggataattacaagaacgcccgggcttcggaaaggttattcataaccctttgttgtccgactctgttgcctccggggcgaccctgccttcgggcgggggctccgggtggacaattcaaactcttgcgtaacttt

SEQ ID NO: 2767 - DNA, 151 bp, Unknown
  Description of Unknown: fungal polynucleotide
  Dothideomycetes; Pleosporaceae
gtaggtgaacctgcggagggatcattacacaataacaaggcgggctggctctctcccgggaggactggccctgctgaattattcacccgtgtcttttgcgtacttcttgtttcctgggcgggctcgcccgccaccaggaccccccataaac

SEQ ID NO: 2768 - DNA, 151 bp, Pyrenophora tritici-repentis
  Dothideomycetes; Pleosporaceae; Pyrenophora Pyrenophora tritici-repentis
gtaggtgaacctgcggagggatcattacacaaatatgaagccggactgggatagggcctcgctgccttgcccgtctggcgccatattcacccatgtctttttgcgtactacttgtttccttggcgggtccgcccgccaattggaccttatt

SEQ ID NO: 2769 - DNA, 151 bp, Alternaria sp.
  Dothideomycetes; Pleosporaceae; Alternaria
gtaggtgaacctgcggagggatcattacacaatatgaaagcgggctggcatccttcggggttacagccttgctgaattattcacccgtgtcttttgcgtacttcttgtttccttggtgggttcgcccaccactaggacaaacataaacctt

SEQ ID NO: 2770 - DNA, 151 bp, Unknown
  Description of Unknown: fungal polynucleotide
  Dothideomycetes; Pleosporaceae
gtaggtgaacctgcggagggatcattacacaaatatgaaggcgggctggacacccccagccgggcactgcttcacggcgtgcgcggctgggccggctctgctgaattattcacccgtgtcttttgcgtacttcttgtttccttggtgggtt

SEQ ID NO: 2771 - DNA, 151 bp, Cladosporium sp.
  Dothideomycetes; Davidiellaceae; Cladosporium
gtaggtgaacctgcggagggatcattacaagaaacgaccccggttttaccaccgggtgatttcataaccctttgttgtccgactctgttgcctccggggcgaccctgccttcgggcgggggctccgggtggacaaattcaaactcttgcgt

SEQ ID NO: 2772 - DNA, 151 bp, Cochliobolus lunatus
  Dothideomycetes; Pleosporaceae; Cochliobolus Cochliobolus lunatus
gtaggtgaacctgcggagggatcattacacaaatgaaaatatgaaggcccttcaaaccggctggattatttttcttcacccttgtcttttgcgcacttgttgtttcctgggcgggttcgctcgccaccaggaccacaccataaaccttttt

SEQ ID NO: 2773 - DNA, 151 bp, Cladosporium sp.
  Dothideomycetes; Davidiellaceae; Cladosporium Cladosporium sp 234B
gtaggtgaacctgcggagggatcattacaagtgaccccggctacggccgggatgttcataaccctttgttgtccgactctgttgcctccggggcgaccctgccttcgggcgggggctccgggtggacacttcaaactcttgcataactttg

SEQ ID NO: 2774 - DNA, 151 bp, Unknown
  Description of Unknown: fungal polynucleotide
  Dothideomycetes; Phaeosphaeriaceae
gtaggtgaacctgcggaaggatcattacactcagtagtttactactgtaaaaggggctgttagtctgtatagcgcaagctgatgagcagctggcctcttttatccacccttgtcttttgcgtacccacgtttcctcggcaggcttgcctgc

SEQ ID NO: 2775 - DNA, 151 bp, Unknown
  Description of Unknown: fungal polynucleotide
  Dothideomycetes
gtaggtgaacctgcggaaggatcattacattcagtagtttactactgtggggagagtggaaaatacccgccttgtctttgggcactgcggcgtacgagtacgctctctttcataacccttgtctttttgcgcactcatgtttcctcggcgg

SEQ ID NO: 2776 - DNA, 151 bp, Aureobasidium pullulans
  Dothideomycetes; Dothioraceae; Aureobasidium Aureobasidium pullulans
gtaggtgaacctgcggaaggatcattaaagagtaagggtgctcagcgcccgacctccaaccctttgttgttaaaactaccttgttgctttggcgggaccgctcggtctcgagccgctggggattcgtcccaggcgagtgcccgccagagtt

SEQ ID NO: 2777 - DNA, 151 bp, Cladosporium sphaerospermum
  Dothideomycetes; Davidiellaceae; Cladosporium Cladosporium sphaerospermum
gtaggtgaacctgcggagggatcattacaagttgaccccggccctcgggccgggatgttcacaaccctttgttgtccgactctgttgcctccggggcgaccctgcctccgggcgggggccccgggtggacatttcaaactcttgcgtaact

SEQ ID NO: 2778 - DNA, 151 bp, Unknown
  Description of Unknown: fungal polynucleotide
  Dothideomycetes; Phaeosphaeriaceae
gtaggtgaacctgcggaaggatcattacaattcagtagcttgctactgtcgggaggcgctgtaagtccgcatagtttaattactgatgagcggcaggccctctgtctgtacccttgtcttttgcgcactcatgtttcctcggcgggcttgc

SEQ ID NO: 2779 - DNA, 151 bp, Unknown
  Description of Unknown: fungal polynucleotide
  Dothideomycetes
gtaggtgaacctgcggaaggatcattaacctttcaaatcagggtgcggcgcggcccccgaggagcggaaacaatccttgggaggtatgcgggggcttcgagccccccatttacgcacgcacgactgccatccttactttacgagcaccttc

SEQ ID NO: 2780 - DNA, 151 bp, Unknown
  Description of Unknown: fungal polynucleotide
  Dothideomycetes
gtaggtgaacctgcggaaggatcattaaatgaaaagctggtttaccagtatacggcccctgggtttgtttctgacaagcgccaggatcagtcgtcatttatacccatgttttttgcgtactacttgtttccttggtaggcttgcctaccat

SEQ ID NO: 2781 - DNA, 151 bp, Cochliobolus lunatus
  Dothideomycetes; Pleosporaceae; Cochliobolus Cochliobolus lunatus
gtaggtgaacctgcggagggatcattacacaaattaaaatatgaaggcttcggctggattatttttatcacccttgtcttttgcgcacttgttgtttcctgggcgggttcgcccgccaccaggaccacaccataaaccttttttatgcagt

SEQ ID NO: 2782 - DNA, 151 bp, Unknown
  Description of Unknown: fungal polynucleotide
  Dothideomycetes; Pleosporaceae
gtaggtgaacctgcggagggatcattgcacaataacaaggcgggctggacacccccagccgggcactgcttcacggcgtgcgcggctgggccggccccgctgaattattcacccttgtcttttgcgtacttcttgtttccttggtgggttc

SEQ ID NO: 2783 - DNA, 151 bp, Curvularia panici
  Dothideomycetes; Pleosporaceae; Curvularia Curvularia panici
gtaggtgaacctgcggagggatcattacacaataacatatgaaggctgtacgcggctgcgccctcgggccagttggctgaggctggagtatttattacccttgtcttttgcgcacttgttgtttcctgggcgggttcgcccgccaccagga

SEQ ID NO: 2784 - DNA, 151 bp, Cladosporium sp.
  Dothideomycetes; Davidiellaceae; Cladosporium Cladosporium sp 1 GP_2013
gtcggtgaacctgcttctttatcattacaagaacgcccgggcttcgtcctttttattcataaccctttgttgtccgcctcttttgcctccggggcgaccctgccttcgggcgggttctccttttttccccttcaaactcttgcgtaacttt

SEQ ID NO: 2785 - DNA, 151 bp, Alternaria sp.
  Dothideomycetes; Pleosporaceae; Alternaria
ttcggtgaacctgcttcttgatcattacacaaatatgaaggcgggctttcccctctcggggttacagccttgctgacttcttcacccttgtcttttgcgtacttcttgtttccttttttttttctccccccactaggacaaacataaacct

SEQ ID NO: 2786 - DNA, 151 bp, Cladosporium sp.
  Dothideomycetes; Davidiellaceae; Cladosporium Cladosporium sp 1 GP_2013
ttcggtgaacctgctgagggatcattacaagaacgcccgggcttcgtcctgtttattcataaccctttgttgtccgactctgttgcctccggggcgaccctgccttcgggcgggggctccgggtgtccccttcaaactcttgcgtaacttt

SEQ ID NO: 2787 - DNA, 151 bp, Unknown
  Description of Unknown: fungal polynucleotide
  Dothideomycetes
gtaggtgaacctgcggaaggatcattatccatcttcaaccaggtgcggtcgcggcctctgggcaaccaggtggtttcgcgccgcattcctgcatcctttttttacgagcacctttcgttctccttcggcggggcaacctgccgctggaact

SEQ ID NO: 2788 - DNA, 151 bp, Stagonospora sp.
  Dothideomycetes; Phaeosphaeriaceae; Stagonospora Stagonospora sp SRC1lsM3a
gtaggtgaacctgcggaaggatcattacattcagtagcctagctacttgttttttacacccttgttttttgcgtacctattgtttcctcggcgggcttgctcgccggttggacaaaacttataaccttttttaaatcttcaatcagcgtct

SEQ ID NO: 2789 - DNA, 151 bp, Dissoconium musae
  Dothideomycetes; Mycosphaerellaceae; Dissoconium Dissoconium musae
gtaggtgaacctgcggagggatcattaccagaagacgcctcggcggaaacgccggggccttcgtccaaccctttgtgaacgtatctctattgccccgggggaaccccgcctgtcacgggcgtgggcccccggtggccaactcaaactctgt

SEQ ID NO: 2790 - DNA, 151 bp, Unknown
  Description of Unknown: fungal polynucleotide
  Dothideomycetes
gtaggtgaacctgcggaaggatcattaatttcggtaggcaactaccgtttgagggcagtagaaactctttggggtcgcccctaaagggaagtatgctgcttttcttaaccctttgactttttgcaaacccaagtttcctcggcaggcttgc

SEQ ID NO: 2791 - DNA, 151 bp, Epicoccum nigrum
  Dothideomycetes; Pleosporaceae; Epicoccum Epicoccum nigrum
gtaggtaaacctgcggaaggatcattacctagagtttgtagacttcagtctgctacctcttacccatgtcttttgagtaccttcgcttcctcggcgggtccgcccgccgattggacaacattcaaaccctttgcagttgcaatcagcgtct

SEQ ID NO: 2792 - DNA, 151 bp, Unknown
  Description of Unknown: fungal polynucleotide
  Dothideomycetes
gtaggtgaacctgcggaaggatcattatagtagaggcctttggccttcacgagatgcaacccttgtctttttgtgaacctttgtttcctcggcagctccgcctgccaacgaggacccccaaaaaccttttgcaatcctagtacaacattct

SEQ ID NO: 2793 - DNA, 151 bp, Dissoconium proteae
  Dothideomycetes; Mycosphaerellaceae; Dissoconium Dissoconium proteae
gtaggtgaacctgcggagggatcattaccagaagccgcgtcggccgcgaggccggcgccttcgccccaccctttgtgaaccgaatctgatttccccgggggaccccgccgcccggcgggcccccggcggaccccctcccaactcgtgttgt

SEQ ID NO: 2794 - DNA, 151 bp, Unknown
  Description of Unknown: fungal polynucleotide
  Dothideomycetes
gtaggtgaacctgcggagggatcattacaagtgaccccggtctaaccaccgggatgttcataaccctttgttgtccgactctgttgcctccggggcgaccctgccttcgggcgggggctccgggtggacacttcaaactcattcatccttt

SEQ ID NO: 2795 - DNA, 151 bp, Alternaria sp.
  Dothideomycetes; Pleosporaceae; Alternaria Alternaria sp MY_2011
gtaggtgaacctgcggagggataattacacaaatatgaaggcgggctggaacctctaggggttacagccttgctgaattatacacccttgtcttttgcgtagttcttgtttcctgggtgggttcgcccaccactaggacaaacataaacct

SEQ ID NO: 2796 - DNA, 151 bp, Aureobasidium sp.
  Dothideomycetes; Dothioraceae; Aureobasidium
gtaggtgaacctgcggaaggatcattaaagagtaagggtgctcagcgcccgacctccaaccctctgttgttaaaactaccttgttgctttggcgggaccgctttggtccgtccgagccgccggggccgtcaaaagcccaggcgagttcccg

SEQ ID NO: 2797 - DNA, 151 bp, Cochliobolus lunatus
  Dothideomycetes; Pleosporaceae; Cochliobolus Cochliobolus lunatus
gtaggtgaacctgcggagggatcattacacaaatacaatatgaaggcttcggctggattatttatttcacccttgtcttttgcgcacttgttgtttcctgggcgggttcgcccgccaccaggaccacaccataaaccttttttgttaatgc

SEQ ID NO: 2798 - DNA, 151 bp, Phaeosphaeriopsis sp.
  Dothideomycetes; Phaeosphaeriaceae; Phaeosphaeriopsis Phaeosphaeriopsis sp C652
gtaggtgaacctgcggaaggatcattacattcagtagcctagctacttgtttacacccttgtttttttgcgcacttcactgtatccctcggcgggcttgctcgccggttggacaacatttataaccttttttaatcttcaatcagcgtctg

SEQ ID NO: 2799 - DNA, 151 bp, Cladosporium sp.
  Dothideomycetes; Mycosphaerellaceae; unidentified uncultured Cladosporium
gtaggtgaacctgcggagggatcattacaagtgaccccggtctaaccaccgggatgttcataaccctttgttgtccgactctgttgcctccggggcgaccctgccttcgggcgggggctccgggtggacacttcaaactcttcattccctt

SEQ ID NO: 2800 - DNA, 151 bp, Stagonospora sp.
  Dothideomycetes; Phaeosphaeriaceae; Stagonospora Stagonospora sp SRC1lsM3a
gtaggtgaacctgcggaaggatcattacattcagtagcctagctacttgtttacacccttgtttttgcgtacctattgtttcctcggcgggcttgctcgccggttggacaaaactataaccttttttaaatcttcaatcagcgtctgaatt

SEQ ID NO: 2801 - DNA, 151 bp, Phoma macrostoma
  Dothideomycetes; Incertae sedis; Phoma Phoma macrostoma
gtaggtgaacctgcggaaggatcattacctagagttgtaggctttgcctgctatctcttacccatgtcttttgagtaccttcgtttcctcggtgggttcgcccgccgatcggacaaaacttaaaccctttgtagttgcaatcagcgtctga

SEQ ID NO: 2802 - DNA, 151 bp, Alternaria sp.
  Dothideomycetes; Pleosporaceae; Alternaria Alternaria sp MY_2011
gtaggtgaacctgcggagggatcattacacaaatatgaaggcgggctggaccctctcggttttaccgccttgcttaattcttcacccttgtcttttgcgtacttcttgtttccttggtgggttcgcccaccactaggacaaacataaacct

SEQ ID NO: 2803 - DNA, 151 bp, Unknown
  Description of Unknown: fungal polynucleotide
  Dothideomycetes; Pleosporaceae
gtaggtgaacctgcggagggatcattacacgataacaaggcgggctggacacccccagccgggcactgcttcacggcgtgcgcggctgggccggctctgctgaattattcacccttgtcttttgcgtactccttgtttccttggtgggttc

SEQ ID NO: 2804 - DNA, 151 bp, Lophiostoma fuckelii
  Dothideomycetes; Lophiostomataceae; Lophiostoma Lophiostoma fuckelii
gtaggtgaacctgcggaaggatcattattgtagggactccggtcccctcaagatgcaacccgtgcctttttcgtagcccgtaacgtttcctcggcagccccgctgccagcgaggaccccccccaaaccaaacctgcaatctcagtataaaa

SEQ ID NO: 2805 - DNA, 151 bp, Cladosporium sp.
  Dothideomycetes; Davidiellaceae; Cladosporium
gtaggtgaacctgcggagggatcattaaaagttgacccccccttcggggagggatgtctccaaaccctttgtcgtccgactctgttgcctccggggcgaccctgcctcacggcgggggccccgggtggacactaccaaactcttgctatct

SEQ ID NO: 2806 - DNA, 151 bp, Unknown
  Description of Unknown: fungal polynucleotide
  Dothideomycetes; Pleosporaceae
gtaggtgaacctgcggagggatcattacacaaatatgaaggcgggctggaacctctcggggttacagccttgctgaactattcacccgtgtcttttgcgtacctcttgtttcctgggcgggctcgcccgccaccaggaccaaccataaacc

SEQ ID NO: 2807 - DNA, 151 bp, Unknown
  Description of Unknown: fungal polynucleotide
  Dothideomycetes; Incertae sedis
gtaggtgaacctgcggagggatcattactgagtgagggcctctggcccgacctccaaccccatgttatctgacactgttgcctccggggcgacccggcctgccttcgggtgtttcggggccccgggtggaccattcaactctgcatctttg

SEQ ID NO: 2808 - DNA, 151 bp, Cochliobolus sp.
  Dothideomycetes; Pleosporaceae; Cochliobolus
gtaggtgaacctgcggagggatcattacacaatacaatatgaaggctgtccgcagctggagtattttattacccttgtcttttgcgcacttgttgtttcctgggcgggttcgctcgccaccaggaccaccaaataaaccttttttatgcag

SEQ ID NO: 2809 - DNA, 151 bp, Alternaria sp.
  Dothideomycetes; Pleosporaceae; Alternaria Alternaria sp MY_2011
gtaggtgaacctgcggagggatcattacacaaatatgaaggcgggctggaacctctcggggttacagccttgctgaattattcacccttgtcttttgcgtacttcttgtttccttggtgggttcgcccaccactagaccaacattaaactt

SEQ ID NO: 2810 - DNA, 151 bp, Alternaria sp.
  Dothideomycetes; Pleosporaceae; Alternaria Alternaria sp MY_2011
gtaggtgaacctgcggagggatcattacaaaaatatgaaggcgggctggaacctctaggggttaaagccttgctgacttattcacccttgtcttttgcgtagttcttgtttccttggtgggttcgcccaccactaggacaaacataaacct

SEQ ID NO: 2811 - DNA, 151 bp, Alternaria sp.
  Dothideomycetes; Pleosporaceae; Alternaria Alternaria sp MY_2011
ttcggtgaacctgctgagggatcattacacaaatatgaaggcgggctttcacctctcggggttacagccttgctgaattattcacccttgtcttttgcgtacttcttgtttccttggtgggttcgccccccactaggacaaacataaacct

SEQ ID NO: 2812 - DNA, 151 bp, Periconia sp.
  Dothideomycetes; Incertae sedis; Periconia Periconia sp
gtaggtgaacctgcggaaggatcattacaacaaggttccctggccctcgaagcttcggcggaggggtgctacagcctgactttatacccaccctttgcctatgtgtacccctattgcttccctcggcgggttcgcccgccgacaggaacca

SEQ ID NO: 2813 - DNA, 151 bp, Alternaria sp.
  Dothideomycetes; Pleosporaceae; Alternaria Alternaria sp MY_2011
gtaggtgaacctgcggagggatcattacacaaatatgaaggcgggctggaacctctcggggttacagccttgctgaattattcacccttgtcttttgcgtacttcttgtttccttggtgggttcgcccaccgattggacaaatttaaaccc

SEQ ID NO: 2814 - DNA, 151 bp, Unknown
  Description of Unknown: fungal polynucleotide
  Dothideomycetes; Pleosporaceae
gtaggtgaacctgcggagggatcattacacaatatgaaagcgggctggcatccttcggggttacagccttgctgaattattcacccgtgtcttttgcgtacttcttgtttccttggtgggtccgcccgccatcaggaccaaccacaaacct

SEQ ID NO: 2815 - DNA, 151 bp, Alternaria sp.
  Dothideomycetes; Pleosporaceae; Alternaria Alternaria sp MY_2011
gtaggtgaacctgcggagggatcattacacaaatatgaaggcgggctggaacctctcggggttacagccttgctgaattattcacccttgtcttttgcgtacttcttgtttcctgggcgggttcgcccgccaccaggaccaaaccataaac

SEQ ID NO: 2816 - DNA, 151 bp, Lewia infectoria
  Dothideomycetes; Pleosporaceae; Lewia Lewia infectoria
gtaggtgaacctgcggagggatcattacacaataacaaggcgggctgggccggccctgctgaattattcacccgtgtcttttgcgtacttcttgtttcctgggtgggctcgcccgccatcaggaccaaccacaaaccttttgcaatagcaa

SEQ ID NO: 2817 - DNA, 151 bp, Alternaria sp.
  Dothideomycetes; Pleosporaceae; Alternaria Alternaria sp MY_2011
ttaggtgaacctgcggagggatcattacacaaatatgaaggcgggctttaccctctcggggttacagccttgctgaattattcacccttgtcttttgcgtacttcttgtttccttgtttggttctccccccactaggacaaacataaacct

SEQ ID NO: 2818 - DNA, 151 bp, Phaeosphaeria sp.
  Dothideomycetes; Phaeosphaeriaceae; unidentified uncultured Phaeosphaeria
gtaggtgaacctgcggaaggatcattacttgcagtagtttactactgttgtaggggctgtggaaattctcctagctgtttcggcagctttgagaaaagtacattcccttataaacccttgtctttttgcgcactcatgtttcctcggtggg

SEQ ID NO: 2819 - DNA, 151 bp, Botryosphaeria parva
  Dothideomycetes; Botryosphaeriaceae; Botryosphaeria Botryosphaeria parva
gtaggtgaacctgcggaaggatcattaccgagttgattcgagctccggctcgactctcccaccctatgtgtacctacctctgttgctttggcgggccgcggtcctccgcaccggcgcccttcggggggctggccagcgcccgccagaggac

SEQ ID NO: 2820 - DNA, 151 bp, Unknown
  Description of Unknown: fungal polynucleotide
  Dothideomycetes; Pleosporaceae
ataggtgaacctgcggagggatcattacacaataacaatgcgggctggacacccccagccgggcactgctttacggcgtgcgcggctgggccggccctgctgaattattcacctgtgtcttttgcgtacttcttgttccctgggggggctc

SEQ ID NO: 2821 - DNA, 151 bp, Aureobasidium pullulans
  Dothideomycetes; Dothioraceae; Aureobasidium Aureobasidium pullulans
gtaggtgaacctgcggaaggatcattaaagagatagggtgctcagcgcccgacctccaaccctttgttgttaaaactaccttgttgctttggcgggaccgctcggtcccgagccgccggggattcgtcccaggcgagcgcccgccagagtt

SEQ ID NO: 2822 - DNA, 151 bp, Alternaria thalictrigena
  Dothideomycetes; Pleosporaceae; Alternaria Alternaria thalictrigena
gtaggtgaacctgcggagggatcattacacaatatgaaggcgggctggagccggccctgctgaattattcacccgtgtcttttgcgtacttcttgtttcctgggtgggctcgcccgccatcaggaccaaccataaacctttttgtaatagc

SEQ ID NO: 2823 - DNA, 151 bp, Lewia infectoria
  Dothideomycetes; Pleosporaceae; Lewia Lewia infectoria
ttcggtgaacctgcttcttgatcattacacaataacaaggcgggctttccccccccagccgggcactgcttcacggctttctcggctgggccggccctgctgaattattcacccttttctttttcttccttcttgtttcctgggtgggctc

SEQ ID NO: 2824 - DNA, 151 bp, Corynespora cassiicola
  Dothideomycetes; Corynesporascaceae; Corynespora Corynespora cassiicola
gtaggtgaacctgcggaaggatcattatcgcaggggcctcgcccccttcgagatagcaccctttgtttatgagcacctctcgtttcctcggcaggctcgcctgccaacggggacccaccacaaacccattgtagtacaagaagtacacgtc

SEQ ID NO: 2825 - DNA, 151 bp, Unknown
  Description of Unknown: fungal polynucleotide
  Dothideomycetes
gtcggtgcccctgcttctttctccttcccagtgccccctttctccccacctttctgttcataaccctttgttttcctcctctttttcctccggggcgaccctgccttcgggcggtttctccttgtggacacttcaaactcttgcgtaactt

SEQ ID NO: 2826 - DNA, 151 bp, Alternaria sp.
  Dothideomycetes; Pleosporaceae; Alternaria
ttcggtgcccctgcttctttctccttccccacatatgccttctttctttcccctctcggggttacagccttgctgccttcttcccccttttcttttgcgtacttcttgtttccttttttttttctccccccactaggacaaacataaacct

SEQ ID NO: 2827 - DNA, 151 bp, Lewia infectoria
  Dothideomycetes; Pleosporaceae; Lewia Lewia infectoria
ttcggtgaacctgctgagggatcattacacaataacaaggcgggctttccacccccagccgggcactgcttcacggcgtgcgcggctgggccggccctgctgaattattcacccgtgtctttttcttccttcttgtttcctgggtgggctc

SEQ ID NO: 2828 - DNA, 151 bp, Unknown
  Description of Unknown: fungal polynucleotide
  Dothideomycetes; Montagnulaceae; unidentified Montagnulaceae sp
gtaggtaaacctgcggaaggatcattaaccgttacggacagtgtgtgctgcggcccccgaggtgaggcaacgagccttcgggaggtctggggtccgccccttcacgcgcacgcgactgccatccttactttacgagcaccttctgttctcc

SEQ ID NO: 2829 - DNA, 151 bp, Unknown
  Description of Unknown: fungal polynucleotide
  Dothideomycetes; Pleosporaceae
gtaggcgaacctgcggagggatcattacacaatatgaaagcgggctggcatccttcggagttacagccttgctgaattattcacccgtgtcttttgcgtacttcttgtttcctgggtgggctcgcccgccatcaggaccaaccacaaacct

SEQ ID NO: 2830 - DNA, 151 bp, Alternaria sp.
  Dothideomycetes; Pleosporaceae; Alternaria
gtcggttcccctgcttctttctccttccccacatatgccttctttctttcccctctctgggttacagccttgcttccttcttcccccttttcttttgcgtacttcttgtttccttttttttttttccccccactaggacaaacataaacct

SEQ ID NO: 2831 - DNA, 151 bp, Phaeosphaeria sp.
  Dothideomycetes; Phaeosphaeriaceae; Phaeosphaeria Phaeosphaeria sp HKC12
gtaggtgaacctgcggaaggatcattacattcagtagcctcgctacttgtttatacccttgatttttgcgtactattgtttcctcggcgggcttgcctgccggttggacaaaactataacctttttaaatcttcaatcagcgtctgaattt

SEQ ID NO: 2832 - DNA, 151 bp, Diplodia corticola
  Dothideomycetes; Botryosphaeriaceae; Diplodia Diplodia corticola
gtaggtgaacctgcggaaggatcattaccgagtgctacgagcgagagctcgttacctcccaccctttgtgaacatacctctgttgctttggcggctctcgccgcgaggggaggccctgaaaagggcccgcccccctcgcgcgccctccgcc

SEQ ID NO: 2833 - DNA, 151 bp, Unknown
  Description of Unknown: fungal polynucleotide
  Dothideomycetes; Davidiellaceae
ttcggtgaacctgcttcttgatcattacaattgacccctttctaaccccctttcttttcataaccctttgttttcctcctcttttgcctccggggcgaccctgccttcgggcggtttctcctggcctccccttcaaactcttgcgtaactt

SEQ ID NO: 2834 - DNA, 151 bp, Davidiella sp.
  Dothideomycetes; Davidiellaceae; Davidiella
ttaggtgaacctgcggagggatcattacaagaacgcccgggcttcttcctttttattcataaccctttgttgtccgactctgttgcctccggggcgaccctgccttcgggcgggggctccggttttccccttcaaactcttgcgtaacttt

SEQ ID NO: 2835 - DNA, 151 bp, Unknown
  Description of Unknown: fungal polynucleotide
  Dothideomycetes; Pleosporaceae
gtaggtgaacctgcggagggatcattacacaatatgaaagcgggttgggacctcacctcggtgagggctccagcttgtctgaattattcacccatgtcttttgcgcacttcttgtttcctgggtgggctcgcccgccatcaggaccaacca

SEQ ID NO: 2836 - DNA, 151 bp, Alternaria sp.
  Dothideomycetes; Pleosporaceae; Alternaria
ttcggtgcacctgcttcttgctccttccacccatatgccggctggctttcccctctcggggttacagccttgctgccttcttcacccttgtcttttgcgtacttcttgtttccttttttttttttccccccactaggacaaacataaacct

SEQ ID NO: 2837 - DNA, 151 bp, Unknown
  Description of Unknown: fungal polynucleotide
  Dothideomycetes; Davidiellaceae
ttaggtgaaccttcggagttctccttcccctttccccctttctccccccctggcttttcataaccctttgttgtccgactctgttgcctccggggcgaccctgccttcgggcgggggctccgggtggacacttcaaactcttgcgtaactt

SEQ ID NO: 2838 - DNA, 151 bp, Unknown
  Description of Unknown: fungal polynucleotide
  Dothideomycetes
gtaggtgaacctgcggagggatcattcccctttccccctttctaaccaccgggatgttcataaccctttgttgtccgactctgttgcctccggggcgaccctgccttcgggcgggggctccgggtggacacttcaaactcttgcgtaactt

SEQ ID NO: 2839 - DNA, 151 bp, Alternaria sp.
  Dothideomycetes; Pleosporaceae; Alternaria
gtaggttcacctgcttctggatcattacacaaatatgaaggcgggcattaacctctcttgtttatatcatttcttccttcttcccccttgtcttttgcgtacttcttgtttccttggtgggttcgcccaccactaggacaaacataaacct

SEQ ID NO: 2840 - DNA, 151 bp, Lewia infectoria
  Dothideomycetes; Pleosporaceae; Lewia Lewia infectoria
gtcttttcccactcggagttctccttcccccctccgccttctttctttccccccccagccgggcactgcttcacggcgtgcgcggctgggccggccctgctgaattattcacccgtgtcttttgcgtacttcttgtttcctgggtgggctc

SEQ ID NO: 2841 - DNA, 151 bp, Lewia infectoria
  Dothideomycetes; Pleosporaceae; Lewia Lewia infectoria
ttaggtgaacctgcggagggatcattcccccctcccccttcgggctggacacccccagccgggcactgcttcacggcgtgcgcggctgggccggccctgctgaattattcacccgtgtcttttgcgtacttcttgtttcctgggtgggctc

SEQ ID NO: 2842 - DNA, 151 bp, Alternaria sp.
  Dothideomycetes; Pleosporaceae; Alternaria Alternaria sp MY_2011
gtaggtgaacctgcggagggatcattccccccctcttccttcgggctggaacctctcggggttacagccttgctgaattattcacccttgtcttttgcgtacttcttgtttccttggtgggttcgcccaccactaggacaaacataaacct

SEQ ID NO: 2843 - DNA, 151 bp, Unknown
  Description of Unknown: fungal polynucleotide
  Dothideomycetes
gtaggtgaacctgcggagggatcattacacaaatacattacaagtgaccccggtctaaccaccgggatgttcataaccctttgttgtccgactctgttgcctccggggcgaccctgccttcgggcgggggctccgggtggacacttcaaac

SEQ ID NO: 2844 - DNA, 151 bp, Lophiostoma sp.
  Dothideomycetes; Lophiostomataceae; Lophiostoma Lophiostoma cf cynaroidis A33
gtaggtgaacctgcggaaggatcattactagggggcttcggccccatcaagataccaccccttgcattttgagtaccttctgtttcctcggcgggcctgcccgccaacggggaccacaccaaacccttctgtagtcgcagtaaacgtctaa

SEQ ID NO: 2845 - DNA, 151 bp, Alternaria sp.
  Dothideomycetes; Pleosporaceae; Alternaria
ttcttttcccattcggcgttctccttccccccctctgccttctttctttcccctctcggggttccctccttgctgaattattcccccttgtcttttgcgtacttcttgtttccttggtgggttcgcccaccactaggacaaacataaacct

SEQ ID NO: 2846 - DNA, 151 bp, Unknown
  Description of Unknown: fungal polynucleotide
  Dothideomycetes; Davidiellaceae
ttcttttcccattcggcgttctccttcccctttccaactttctccccccctttcttttcataacccttttttgtccgactctgttgcctccggggcgaccctgccttcgggcgggggctccgggtggacacttcaaactcttgcgtaactt

SEQ ID NO: 2847 - DNA, 151 bp, Lewia infectoria
  Dothideomycetes; Pleosporaceae; Lewia Lewia infectoria
gtcttttccacttcggagttctccttcccccctcaaccttctttctttccccccccagccgggcccttcttcacggcgtgcgcggctgggccggccctgctgaattattcacccgtgtcttttgcgtacttcttgtttcctgggtgggctc

SEQ ID NO: 2848 - DNA, 151 bp, Alternaria sp.
  Dothideomycetes; Pleosporaceae; Alternaria
gtcttttcccaatcggcgttctccttcccctactatgccttctttctttcccctctcggggttcccgccttgctgaattattcccccttgtcttttgcgtacttcttgtttccttggtgggttcgcccaccactaggacaaacataaacct

SEQ ID NO: 2849 - DNA, 151 bp, Lewia infectoria
  Dothideomycetes; Pleosporaceae; Lewia Lewia infectoria
gtcttttcccaatcggcgttctccttcccccattacacttttttctttcccccccccgccgggccctgcttcacggcgtgcgcggctgggccggccctgctgaattattcacccgtgtcttttgcgtacttcttgtttcctgggtgggctc

SEQ ID NO: 2850 - DNA, 151 bp, Alternaria sp.
  Dothideomycetes; Pleosporaceae; Alternaria
gtcttttccacttcggagttctccttccccccctattccttctttctttcccctctcggggttcccgccttgctgaattattcacccttgtcttttgcgtacttcttgtttccttggtgggttcgcccaccactaggacaaacataaacct

SEQ ID NO: 2851 - DNA, 151 bp, Emericella nidulans
  Eurotiomycetes; Trichocomaceae; Emericella Emericella nidulans
gtaggtgaacctgcggaaggatcattgtcgtgaccctgaccaaaacagaccgtgcacgcgtcatccaatccgtcggcgatggcattgtccgtcgctcggccaatatgcctcgaccacctcccctccttggagtgggtgggggctcggggta

SEQ ID NO: 2852 - DNA, 151 bp, Penicillium concentricum
  Eurotiomycetes; Trichocomaceae; Penicillium Penicillium concentricum
gtaggtgaacctgcggaaggatcattactgagtgagggccctctgggtccaacctcccacccgtgtttattataccttgttgcttcggcgggcccgcgcccgccgaagacatctcgaactctgtctgaagattgtagtctgagtataaata

SEQ ID NO: 2853 - DNA, 151 bp, Penicillium sp.
  Eurotiomycetes; Trichocomaceae; Penicillium
gtaggtgaacctgcggaaggatcattaccgagtgagggccctctgggtccaacctcccacccgtgtttattttaccttgttgcttcggcgagcctgccttcgggctgccggggggcatctgcccccgggtccgcgctcgccggagacacct

SEQ ID NO: 2854 - DNA, 151 bp, Talaromyces sp.
  Eurotiomycetes; Trichocomaceae; Talaromyces
gtaggtgaacctgcggaaggatcattaccgagtgcgggcccctcgtggcccaacctcccacccttatctctatacacctgttgctttggcgggcccaccggggccacctggtcgccgggggacgttcgtccccgggcccgcgcccgccgaa

SEQ ID NO: 2855 - DNA, 151 bp, Penicillium sp.
  Eurotiomycetes; Trichocomaceae; Penicillium
gtaggtgaacctgcggaaggatcattaccgagtgagggccctctgggtccaacctcccacccgtgtttatcgtaccttgttgcttcggcgggcccgcctcacggccgccggggggcatctgcccccgggcccgcgcccgccgaagacacac

SEQ ID NO: 2856 - DNA, 151 bp, Penicillium citrinum
  Eurotiomycetes; Trichocomaceae; Penicillium Penicillium citrinum
gtaggtgaacctgcggaaggatcattaccgagtgcgggcccctcggggcccaacctcccacccgtgttgcccgaacctatgttgcctcggcgggccccgcgcccgccgacggcccccctgaacgctgtctgaagttgcagtctgagaccta

SEQ ID NO: 2857 - DNA, 151 bp, Aspergillus flavus
  Eurotiomycetes; Trichocomaceae; Aspergillus Aspergillus flavus
gtaggtgaacctgcggaaggatcattaccgagtgtagggttcctagcgagcccaacctcccacccgtgtttactgtaccttagttgcttcggcgggcccgccattcatggccgccgggggctctcagccccgggcccgcgcccgccggaga

SEQ ID NO: 2858 - DNA, 151 bp, Emericella nidulans
  Eurotiomycetes; Trichocomaceae; Emericella Emericella nidulans
gtaggtgaacctgcggaaggatcattgtcgtgaccctgaccaaaacagactgcgcacgcgtcatccaatccgtcggcgacggcaccgtccgtcgctcggccaatgcctcgaccacctcccctcctcggagcgggtgggggctcggggtaaa

SEQ ID NO: 2859 - DNA, 151 bp, Unknown
  Description of Unknown: fungal polynucleotide
  Eurotiomycetes; Trichocomaceae
gtaggtgaacctgcggaaggatcattactgagtgagggccctctgggtccaacctcccacccgtgtttattataccttgttgcttcggcgggcccgccgtaaggccgccggggggcttctgcccccgggcccgcgcccgccgaagacatct

SEQ ID NO: 2860 - DNA, 151 bp, Penicillium sp.
  Eurotiomycetes; Trichocomaceae; Penicillium
gtaggtgaacctgcggaaggatcattaccgagtgagggccctctgggtccaacctcccacccgtgtttattttaccttgttgcttcggcgagcctgccttttggctgccgggggacgtctgtccccgggtccgcgctcgccgaagacacct

SEQ ID NO: 2861 - DNA, 151 bp, Eurotium sp.
  Eurotiomycetes; Trichocomaceae; unidentified uncultured Eurotium
gtaggtgaacctgcggaaggatcattaccgagtgcgggccctctgggtccaacctcccatccgtgtctatctgtaccctgttgcttcggcgtggccacggcccgccgaagactaacatttgaacactgtctgaagtttgcagtctgagttt

SEQ ID NO: 2862 - DNA, 151 bp, Penicillium polonicum
  Eurotiomycetes; Trichocomaceae; Penicillium Penicillium polonicum
gtaggtgaacctgcggaaggatcattaccgagtgagggccctttgggtccaacctcccacccgtgtttattttaccttgttgcttcggcgggcccgcctttactggccgccggggggctcacgcccccgggcccgcgcccgccgaagacac

SEQ ID NO: 2863 - DNA, 151 bp, Penicillium sp.
  Eurotiomycetes; Trichocomaceae; Penicillium
gtaggtgaacctgcggaaggatcattaccgagtgcgggccctcgtggcccaacctcccacccttgtctctatacacctgttgctttggcgggcccaccggggccacctggtcgccgggggacatctgtccccgggcccgcgcccgccgaag

SEQ ID NO: 2864 - DNA, 151 bp, Emericella nidulans
  Eurotiomycetes; Trichocomaceae; Emericella Emericella nidulans
gtaggtgaacctgcggaaggatcattgtcgtgaccctgaccaaaacagaccgcgcacgcgtcatccaacccgtcggtgacggcactgtccatcgctcggccaatgcctcgaccacctcccctcctcggagcgggtgggggctcagggtaaa

SEQ ID NO: 2865 - DNA, 151 bp, Emericella nidulans
  Eurotiomycetes; Trichocomaceae; Emericella Emericella nidulans
gtaggtgaacctgcggaaggatcattgtcgtgcccctgaccaaaacagaccgcgcacgcgtcatccaatccgtcggtgacggcaccgtccgtcgctcggccaatgcctcgaccacctcccctcctcggagcgggtggggcccggggtaaaa

SEQ ID NO: 2866 - DNA, 151 bp, Aspergillus caesiellus
  Eurotiomycetes; Trichocomaceae; Aspergillus Aspergillus caesiellus
gtaggtgaacctgcggaaggatcattaccgagtgcgggccctctgggtccaacctcccatccgtgtctcttgtaccctgttgcttcggcgggcccgccttcatggccgccggggggcttctgcccccgggcccgcgcccgccggagacccc

SEQ ID NO: 2867 - DNA, 151 bp, Penicillium funiculosum
  Eurotiomycetes; Trichocomaceae; Penicillium Penicillium funiculosum
gtaggtgaacctgcggaaggatcattaccgagtgcgggccctcgtggcccaacctcccacccttgtctctctacacctgttgctttggcgggcccactggggctccctggtcgccgggggacgcctgtccccgggcccgcgcccgccgaag

SEQ ID NO: 2868 - DNA, 151 bp, Emericella nidulans
  Eurotiomycetes; Trichocomaceae; Emericella Emericella nidulans
gtaggtgaacctgcggaaggatcattgtcgtgaccttgaccaaaacagaccgcgcacgcgtcatccaatccatcggcgacggcaccgtccgtcgctcggccaatgccttgaccacctcccctcctcggagtgggtgggggctcggggtaaa

SEQ ID NO: 2869 - DNA, 151 bp, Emericella nidulans
  Eurotiomycetes; Trichocomaceae; Emericella Emericella nidulans
gtaggtgaacctgcggaaggatcattgtcgtgaccctgaccaaaacagaccgtgcacgcgtcatccaatccgtcggcggcggcattgtccgtcgctcggccaatgcctcgaccacctcccctcctcggagtgggtgggggctcggggtaaa

SEQ ID NO: 2870 - DNA, 151 bp, Emericella nidulans
  Eurotiomycetes; Trichocomaceae; Emericella Emericella nidulans
gtaggtgaacctacggaaggatcattgtcgtgaccctgaccaaaatagaccgcgcacgcgtcatccaatccgtcggtgacggcactgtccgtcgctcggccaatgcctcgaccacctcccctcctcggagcgggtgggggctcggggtaaa

SEQ ID NO: 2871 - DNA, 151 bp, Penicillium spinulosum
  Eurotiomycetes; Trichocomaceae; Penicillium Penicillium spinulosum
gtaggtgaacctgcggaaggatcattactgagtgagggccctctgggtccaacctcccacccgtgtttattgtaccttgttgcttcggtgcgcccgcctcacggccgccggggggcttctgcccccgggtccgcgcgcaccggagacacca

SEQ ID NO: 2872 - DNA, 151 bp, Penicillium sp.
  Eurotiomycetes; Trichocomaceae; Penicillium
gtaggtgaacctgcggaaggatcattaccgagtgcgggccctcgcggcccaacctcccacccttgtctctatacacctgttgctttggcgggcccaccggggccacctggtcgccgggggacgcacgtccccgggcccgcgcccgccgaag

SEQ ID NO: 2873 - DNA, 151 bp, Emericella nidulans
  Eurotiomycetes; Trichocomaceae; Emericella Emericella nidulans
attggtgaacctgcggaaggatcattgtcgtgaccctgaccaaaacagaccgtgcacgcgtcatccaatccatcggcaacggcatagtccgtcgctcggccaatgcctcgaccacctcccctcctcggagtgggtgggggcttggggtaaa

SEQ ID NO: 2874 - DNA, 151 bp, Penicillium herquei
  Eurotiomycetes; Trichocomaceae; Penicillium Penicillium herquei
gtaggtgaacctgcggaaggatcattactgagtgagggccctctgggtccaacctcccacccgtgtttattgtaccttgttgcttcggcaggcccgcctcacggccgccggggggctttccgcccccgggcccgcgcctgccggagacaat

SEQ ID NO: 2875 - DNA, 151 bp, Emericella nidulans
  Eurotiomycetes; Trichocomaceae; Emericella Emericella nidulans
gtaggtgaacctgcggaattgtcgtgaccctgaccaaaacagactgcgcacgcgtcatccaatccgtcggcgacggcaccgtccgtcgctcggccaatgcctcgaccacctcccctcctcggagcgggtgggggctcggggtaaaagaacc

SEQ ID NO: 2876 - DNA, 151 bp, Penicillium bialowiezense
  Eurotiomycetes; Trichocomaceae; Penicillium Penicillium bialowiezense
gtaggtgaacctgcggaaggatcattaccgagtgagggccctctgggttcaacctcccacccgtgtttatttaccttgttgcttcggcgagcctgccttttggctgccgggggacgtcagtccccgggtccgtgctcgccggagacacctt

SEQ ID NO: 2877 - DNA, 151 bp, Strelitziana mali
  Eurotiomycetes; Incertae sedis; Strelitziana Strelitziana mali
gtaggtgaacctgcggaaggatcattaccgagttagggtgcttctcagcgcccgacctcccaaccctttgtctatgataccatacagttgcttcggcgtgccgagggttaagactctcgccggacttccagtcgggagcgtgcacgtcgac

SEQ ID NO: 2878 - DNA, 151 bp, Emericella nidulans
  Eurotiomycetes; Trichocomaceae; Emericella Emericella nidulans
gtaggtgaacctgcggaaggatcattgccgtgaccctggccaaaatagaccgtgcacgcgtcatccaatccgtcggcgacggcattgtccgtcgctcgccaatatgcctcgaccacctcccctcctcggagtgggtgggggctcggggtaa

SEQ ID NO: 2879 - DNA, 151 bp, Emericella nidulans
  Eurotiomycetes; Trichocomaceae; Emericella Emericella nidulans
gtaggtgaacctgcggaaggatcattgtcgtgaccctgaccaaaacagaccgcgcacgcgtcatccaatccgtcggtgacggcaccgtccgtcgctcggcctatgcctcgaccacctcccctccacggagtgggtgggggctcgaggcaaa

SEQ ID NO: 2880 - DNA, 151 bp, Emericella nidulans
  Eurotiomycetes; Trichocomaceae; Emericella Emericella nidulans
gtaggggaacctgcggaaggatcattgtcgtgaccctgaccaaaacagaccgcgcacgcatcatccagtccgtcggcgacggcaccgtccgtcgctcggccaatgcctcgaccacctcccctcctcggagcgggtgggggcccggggtaaa

SEQ ID NO: 2881 - DNA, 151 bp, Emericella nidulans
  Eurotiomycetes; Trichocomaceae; Emericella Emericella nidulans
gtaggtgagcctgcggaaggatcattgtcgtgaccctgaccaaaacagaccgcgcacgcgtcatccaatccgtcggcgacggcactgtccgtcgctcggccaatgcctcgaccacctcccctcctcggagcgggtgggggctcttggtaaa

SEQ ID NO: 2882 - DNA, 151 bp, Emericella nidulans
  Eurotiomycetes; Trichocomaceae; Emericella Emericella nidulans
gtaggtgaacctgcggaaggatcattgtcgtgaccctgaccaaaacagaccgcgcacgcgtcatccaatccgtctgcgacggcactgtccgtcgctcggccaatgcctcgaccacctcccctcctcggagcaggtgggggcttggggtaaa

SEQ ID NO: 2883 - DNA, 151 bp, Emericella nidulans
  Eurotiomycetes; Trichocomaceae; Emericella Emericella nidulans
gtaggtgaacttgcggaaggatcattttcgtgaccctgaccaaaacagaccacgcacgcgtcatccaaaccgtcggcgacggcaccatccatcgctcggccaatgcctcgaccacctcccctcctcggagcgggtgggggatcgcggtaaa

SEQ ID NO: 2884 - DNA, 151 bp, Emericella nidulans
  Eurotiomycetes; Trichocomaceae; Emericella Emericella nidulans
gtaggtgaacctgcggaaggatctttgtcgtgaccttgaccaaaatagaccgcgcacgcgtcatccaatctgtcggcgacggcaccgtccgtcgctcggataatgcctcgaccacctcccctccttggagcgggtgggggctcggggtaaa

SEQ ID NO: 2885 - DNA, 151 bp, Emericella nidulans
  Eurotiomycetes; Trichocomaceae; Emericella Emericella nidulans
gtaggtgaacctgcggaaggatcattgtcgtgaccctgaacaaaacagaccgcgcatgcgtcatccaatccgttggcgatggcaccgtccatcgcccggccaatgcctcgaccacctcccctcctcggagcgggtgggggctcggggtaaa

SEQ ID NO: 2886 - DNA, 151 bp, Chaetosphaeronema sp.
  Incertae sedis; Incertae sedis; Chaetosphaeronema Chaetosphaeronema sp
gtaggtgaacctgcggaaggatcattacactcagtagatctctactgctcagggagaggggaaagtttccagcatgcttcggcggctggtgacgagtacgctctctatctgaacccttgtctttttgtgtactcttgtttcctcggcgggc

SEQ ID NO: 2887 - DNA, 151 bp, Rhizopus oryzae
  Incertae sedis; Rhizopodaceae; Rhizopus Rhizopus oryzae
gtaggtgaacctgcggaaggatcattaattatgttaaagcgccttaccttagggtttcctctggggtaagtgattgcttctacactgtgaaaatttggctgagagactcagactggtcatgggtagacctatctggggtttgatcgatgcc

SEQ ID NO: 2888 - DNA, 151 bp, Mucor sp.
  Incertae sedis; Mucoraceae; Mucor
gtaggtgaacctgcggaaggatcattaaataatcaataattttggcttgtccattattatctatttactgtgaaatgtattattacttgacgcttgagggatgctccactgctataaggataggcggtggggatgctaaccgagtcataat

SEQ ID NO: 2889 - DNA, 151 bp, Mucor fragilis
  Incertae sedis; Mucoraceae; Mucor Mucor fragilis
gtaggtgaacctgcggaaggatcattaaataatcaataattttggcttgtccatcattatctatttactgtgaactgtattattacttgacgcttgagggatgttccaatgctataaggataggcactggaaatgttaaccgagtcataat

SEQ ID NO: 2890 - DNA, 151 bp, Setophoma chromolaenae
  Incertae sedis; Incertae sedis; Setophoma Setophoma chromolaenae
gtaggtgaacctgcggaaggatcattaccttctagttattttgactagtcgggggctggcttgcgacgtcccaaaaggacccctgccgccctggctacatccttgtctattgcgtactacatgtttcctcggtaggcttgcctgccgattg

SEQ ID NO: 2891 - DNA, 151 bp, Scolecobasidium sp.
  Incertae sedis; Incertae sedis; Scolecobasidium Scolecobasidium sp FF_2011
gtaggtgaacctgcggaaggatcattactgagtggctttcttgaaagagaggttacccgatctgatgtcatttgatcgttggggtgcagtgtggttttgggagaggactagtgatcgggtaaccgagagctagttcgaaactcgaatcata

SEQ ID NO: 2892 - DNA, 151 bp, Mucor brunneogriseus
  Incertae sedis; Mucoraceae; Mucor Mucor brunneogriseus
gtaggtgaacctgcggaaggatcattaaataatcaataatcttggcttgtccattattatctatttactgtgaactgtattattatttgacgtttgagggatgttccaatgttataaggatagacattggagatgttaaccgagtcataat

SEQ ID NO: 2893 - DNA, 151 bp, Choanephora cucurbitarum
  Incertae sedis; Choanephoraceae; Choanephora Choanephora infundibulifera f cucurbitarum
gtaggtgaacctgcggaaggatcattaaataaataagaagtaatttggcttgtcctattactatctattttactgtgaactgttttatttcatagtgcttgagggatgttcttatgctatatgggtaggcatagggaatgttaaccgagct

SEQ ID NO: 2894 - DNA, 151 bp, Malassezia sp.
  Incertae sedis; unidentified; unidentified uncultured Malassezia
gtaggtgaacctgcagaaggatcattagtgaagatttgggcaggccatacggacgccacaaagtgtccctggccgcctacacccactatacatccacaaacccgcgtgcactgtccttggaaagggcatttggagagaaaaaggaagagaa

SEQ ID NO: 2895 - DNA, 151 bp, Scolecobasidium sp.
  Incertae sedis; Incertae sedis; Scolecobasidium Scolecobasidium sp HF12231
gtaggtgaacctgcggaaggatcattactgagtggttttcgtcgcgagacgagctgcccgacctgatgtcatttggagcggggcttgctggagggggaatgggtttgcggtgacccggacgaggcggaagcctgggaagggaaggtgcgga

SEQ ID NO: 2896 - DNA, 151 bp, Mortierella sp.
  Incertae sedis; Mortierellaceae; Mortierella
gtaggtgaacctgcggaaggatcattcacaaacgagtgttttatggcactctttaaaaatccatatccaccttgtgtgcaatgtttgttgggaaagtcttttctttcccttcataaatatcaacctatatctttaacaacattcgtctgat

SEQ ID NO: 2897 - DNA, 151 bp, Mortierella elongata
  Incertae sedis; Mortierellaceae; Mortierella Mortierella elongata
gtaggtgaacctgcggaaggatcattcataataagtgttttatggcactttttaaatccatatccaccttgtgtgcaatgtcagtcgatcttcttcatggagatcgaccaaacatcaacctttatcttttaactctttgtctgaaaaatat

SEQ ID NO: 2898 - DNA, 151 bp, Mucor ardhlaengiktus
  Incertae sedis; Mucoraceae; Mucor Mucor ardhlaengiktus
gtaggtgaacctgcggaaggatcattaaataatttgataattacaaaattatcttatttactgtgaactgttttatttatgacatataaggggatgactatatactataagggtaggtatatagaatgttaacctagtcataatcaagctt

SEQ ID NO: 2899 - DNA, 151 bp, Mortierella sp.
  Incertae sedis; Mortierellaceae; Mortierella
gtaggtgaacctgcggaaggatcattcataataagtgttttatggcactttttaaatccatatccaccttgtgtgcaatgtcagttgatcttctttatggagattgaccaaacatcaacctaattttttaactctttgtctgaaaaatatt

SEQ ID NO: 2900 - DNA, 151 bp, Mortierella sp.
  Incertae sedis; Mortierellaceae; Mortierella Mortierella sp WD35C
gtaggtgaacctgcggaaggatcattcataatcaagtgtttttatggcactttcaaaaatccatatccaccttgtgtgcaatgtcatctctctgggggctgccggctgtcaaaagccgtgtggtcacctttgggatttatatctactcaga

SEQ ID NO: 2901 - DNA, 151 bp, Crocicreas tomentosum
  Leotiomycetes; Helotiaceae; Crocicreas Crocicreas cf tomentosum F_155
gtaggtgaacctgcggaaggatcattacagtgttctctgcccctcgcgggtagaaacgcccacccttgtatattatatcttgttgctttggcaggccgccctcgggcaccggctccggctggatcgtgcctgccagaggcccctaactctt

SEQ ID NO: 2902 - DNA, 151 bp, Botrytis sp.
  Leotiomycetes; Sclerotiniaceae; Botrytis Botrytis sp CID95
gtaggtgaacctgcggaaggatcattacagagttcatgcccgaaagggtagacctcccacccttgtgtattattactttgttgctttggcgagctgccttcgggccttgtatgctcgccagagaataccaaaactctttttattaatgtcg

SEQ ID NO: 2903 - DNA, 151 bp, Leptodontidium sp.
  Leotiomycetes; Incertae sedis; Leptodontidium Leptodontidium sp
gtaggtgaacctgcggagggatcattacagagttcgtgccctcgcgggtagatctcccaccctgtgttattgctacctttgttgctttggcgggccgccctcggctaccggccccggctggtacgcgcccgccagaggaccccaaaccctg

SEQ ID NO: 2904 - DNA, 151 bp, Sporobolomyces roseus
  Microbotryomycetes; Incertae sedis; Sporobolomyces Sporobolomyces roseus
gtaggtgaacctgcggaaggatcattagtgaataaatagggtgtccaatttaacttggaacccgaccttctcacatctaaccctgtgcatctgtatataatggcgagcaattttcgaattgtgagccatttcactttataaacactagtct

SEQ ID NO: 2905 - DNA, 151 bp, Sporidiobolales sp.
  Microbotryomycetes; Incertae sedis; unidentified Sporidiobolales sp
gtaggtgaacctgcggaaggatcattaatgaaatgcaaggacgctctttttagaggtccgacccaaatcattttcctttacactgtgcacatactacttttttacaccaatttttaacacatcagttttaagaatgtaaatcaagtctcga

SEQ ID NO: 2906 - DNA, 151 bp, Sporobolomyces symmetricus
  Microbotryomycetes; Incertae sedis; Sporobolomyces Sporobolomyces symmetricus
gtaggtgaacctgcggaaggatcattaatgaaatgcaaggacgctctttttagaggtccgaccaactcatttacctttacactgtgcacatactacttttttacaccaattttttaacgcattagtttaagaatgtaaaatcagtctcgaa

SEQ ID NO: 2907 - DNA, 151 bp, Sporobolomyces oryzicola
  Microbotryomycetes; Incertae sedis; Sporobolomyces Sporobolomyces oryzicola
gtaggtgaacctgcggaaggatcattaatgaaatttaaggacgctctttttagaggtcccatcaattacattttacctttactctgtgcacacactactctttacaccatttcttaactctatagttctaagaatgtaaaacaagtctcga

SEQ ID NO: 2908 - DNA, 151 bp, Unknown
  Description of Unknown: fungal polynucleotide
  Microbotryomycetes; Incertae sedis
gtaggtgaacctgcggaaggatcattagtgaacataggacgtccaacttaacttggagtccgaactctcactttctaaccctgtgcatttgtttggggtagtagcctctcggggcgaatccctattcacttataaacacaaagtctatgaa

SEQ ID NO: 2909 - DNA, 151 bp, Sporidiobolales sp.
  Microbotryomycetes; Incertae sedis; unidentified Sporidiobolales sp
gtaggtgaacctgcggaaggatcattagtgaataacaggacgttcaatttaacttgaagtccgaactctcacatctaaccctgtgcatttgttttggttagtagagcgcttgcgttcgaacacctcttcattttacaaacactaagtcaaa

SEQ ID NO: 2910 - DNA, 151 bp, Sporobolomyces ruberrimus
  Microbotryomycetes; Incertae sedis; Sporobolomyces Sporobolomyces ruberrimus
gtaggtgaacctgcggaaggatcattattgaaaacaagggtgtccaatttaacttggaacccaaacttctcaattctaactttgtgcatctgtattaatggcgagcaacttcggttgtgagccttcacttacaaaacactagtctatgaat

SEQ ID NO: 2911 - DNA, 151 bp, Sporobolomyces sp.
  Microbotryomycetes; Incertae sedis; Sporobolomyces Sporobolomyces sp TY_241
gtaggtgaacctgcggaaggatcattagtgaatactaggacgttcaatttaacttgaagtccgaactctcactttctaaccctgtgcatttgttttggttagtaggattcgtctgaacacctcttcatttacaaacacaaagtctatgaat

SEQ ID NO: 2912 - DNA, 151 bp, Rhodotorula minuta
  Microbotryomycetes; Incertae sedis; Rhodotorula Rhodotorula minuta
gtaggtgaacctgcggaaggatcattaatgaattttaggacgttctttttagaagtccgaccctttcattttcttacactgtgcacacacttcttttttacacacacttttaacacattagtataagaatgtaatagtctcttaattgagc

SEQ ID NO: 2913 - DNA, 151 bp, Sporobolomyces ruberrimus
  Microbotryomycetes; Incertae sedis; Sporobolomyces Sporobolomyces ruberrimus
gtaggtgaacctgcggaaggatcattattgaaaacaagggtgtccaatttaacttggaacccgaacttctcaattctaactttgtgcatctgtattatggcgagcagtcttcggattgtgagccttcacttataaacactagtctatgaat

SEQ ID NO: 2914 - DNA, 151 bp, Unknown
  Description of Unknown: fungal polynucleotide
  Microbotryomycetes; Leucosporidiaceae
gtaggtgaacctgcggaaggatcattagtgaatattagcgcatctcttcggagagcgtgacctccactttctaactctgtgcatttattggcggaagaacttgagcaatcgagcgtcttctgcggctcattttataacactagttaaagta

SEQ ID NO: 2915 - DNA, 151 bp, Rhodosporidium diobovatum
  Microbotryomycetes; Incertae sedis; Rhodosporidium Rhodosporidium diobovatum
gtaggtgaacctgcggaaggatcattagtgaatctaggacgtccaacttaacttggagtccgaactctcactttctaaccctgtgcatctgttaattggaatagtagctcttcggagtgaaccaccattcacttataaaacacaaagtcta

SEQ ID NO: 2916 - DNA, 151 bp, Sporobolomyces oryzicola
  Microbotryomycetes; Incertae sedis; Sporobolomyces Sporobolomyces oryzicola
gtaggtgaacctgcggaaggatcattaatgaaattcaaggacgctctttttagaggtccgaccaattacattttacctttactctgtgcacacactactctttacaccattttttaactctatagttttaagaatgtaaaacaagtctcga

SEQ ID NO: 2917 - DNA, 151 bp, Rhodosporidium diobovatum
  Microbotryomycetes; Incertae sedis; Rhodosporidium Rhodosporidium diobovatum
gtaggtgaacctgcggaaggatcattagtgaatctaggacgtccaacttaacttggagtccgaactctcactttctaaccctgtgcatctgttttaaaattggccagtagctcttcggagcgaaccaccatttttcacttatacaaacaca

SEQ ID NO: 2918 - DNA, 151 bp, Unknown
  Description of Unknown: fungal polynucleotide
  Pezizomycetes; Pezizaceae; unidentified Pezizaceae sp GB359
gtaggtgaacctgcggaaggatcattacaaaataaaaagaaaagaaaaaaccttttggtcttttttttaattttattttacatctatatctttctgtttacattatccatgtttcttccactggacaggttataatttgttttgattaata

SEQ ID NO: 2919 - DNA, 151 bp, Candida railenensis
  Saccharomycetes; Incertae sedis; Candida Candida railenensis
gtaggtgaacctgcggaaggatcattacagtattcttttgccagcgcttaattgcgcggcgaaaaaccttacacactatgtttttttaatttgaaactattgctttggtctggcttagaaataggttgggccaaaggttttatcaaaactt

SEQ ID NO: 2920 - DNA, 151 bp, Saccharomyces cerevisiae
  Saccharomycetes; Saccharomycetaceae; Saccharomyces Saccharomyces cerevisiae
gtaggtgaacctgcggaaggatcattaaagaaatttaataattttgaaaatggatttttttttttttgttttggcaagagcatgagagcttttactgggcaagaagacaagagatggagagtccagccgggcctgcgcttaagtgcgcggt

SEQ ID NO: 2921 - DNA, 151 bp, Candida subhashii
  Saccharomycetes; Incertae sedis; Candida Candida subhashii
gtaggtgaacctgcggaaggatcattacagttagtctgcgcttagctgcgcgatttcacacagtgttttctttgaagaactttctccagcgggacgcaagtcacgctgggggtatactcaatataactttttaaaaaattgtcaaaacaaa

SEQ ID NO: 2922 - DNA, 151 bp, Meyerozyma guilliermondii
  Saccharomycetes; Debaryomycetaceae; Meyerozyma Meyerozyma guilliermondii
gtaggtgaacctgcggaaggatcattacagtattcttttgccagcgcttaactgcgcggcgaaaaaccttacacacagtgtctttttgatacagaactcttgctttggtttggcctagagataggttgggccagaggtttaacaaaacaca

SEQ ID NO: 2923 - DNA, 151 bp, Unknown
  Description of Unknown: fungal polynucleotide
  Saccharomycetes
gtaggtgaacctgcggaaggatcattaaaattaatttattacattgtttttgaagcaaacactaataaccattaatattcaacaacctaaaaaaaatcaaaactttcaacaacggatctcttggttctcgcatcgatgaagaacgcagcat

SEQ ID NO: 2924 - DNA, 151 bp, Candida intermedia
  Saccharomycetes; Incertae sedis; Candida Candida intermedia
gtaggtgaacctgcggaaggatcattaaaatatacttattacactgtttttgaagcaaacacataccaatttaaatttcaatttctttaaaaatcaaaactttcaacaacggatctcttggttctcgcatcgatgaagaacgcagcatctg

SEQ ID NO: 2925 - DNA, 151 bp, Clavispora lusitaniae
  Saccharomycetes; Metschnikowiaceae; Clavispora Clavispora lusitaniae
gtaggtgaacctgcggaaggatcattaaaaaacattatacactttgcatttgcgaacaaaaaaataaatttttttattcgaatttcttaatatcaaaactttcaacaacggatctcttggttctcgcatcgatgaagaacgcagcatctga

SEQ ID NO: 2926 - DNA, 151 bp, Clavispora lusitaniae
  Saccharomycetes; Metschnikowiaceae; Clavispora Clavispora lusitaniae
gtaggtgaacctgcggaaggatcattaaaatacaaattacactttgcatttgcgaacaaaaaaataaattttttattcgaatttcttaatatcaaaactttcaacaacggatctcttggttctcgcatcgatgaagaacgcagcatctgac

SEQ ID NO: 2927 - DNA, 151 bp, Candida quercitrusa
  Saccharomycetes; Incertae sedis; Candida Candida quercitrusa
gtaggtgaacctgcggaaggatcattacagtattcttttgccagcgcttaattgcgcggcgaaaaaccttacacacagtgatttctttctttgaaaacattgctttggtctggcgcaagttgggccaaaggtttattaaacttcaatttta

SEQ ID NO: 2928 - DNA, 151 bp, Unknown
  Description of Unknown: fungal polynucleotide
  Saccharomycetes
gtaggtgaacctgcggaaggatcattatagatttgatatacactatcataacacttaccgacctagaagctttggcggcttgccgtcaaagatttaacaaacaaatataacttgtcaaccaacaaaataattaaaactttcaacaacggat

SEQ ID NO: 2929 - DNA, 151 bp, Clavispora lusitaniae
  Saccharomycetes; Metschnikowiaceae; Clavispora Clavispora lusitaniae
gtaggtgaacctgcggaaggatcattaaaaaatacattacacattgtttttgcgaacaaaaaaataaatttttttattcgaatttcttaatatcaaaactttcaacaacggatctcttggttctcgcatcgatgaagaacgcagcatctga

SEQ ID NO: 2930 - DNA, 151 bp, Unknown
  Description of Unknown: fungal polynucleotide
  Saccharomycetes
gtaggtgaacctgcggaaggatcattaacataatattcttacacactgtttttttacaacaaaacaaacatatctaatctataaatctacgttttaaaattcttaaaactttcaacaacggatctcttggttctcgcatcgatgaagaacg

SEQ ID NO: 2931 - DNA, 151 bp, Unknown
  Description of Unknown: fungal polynucleotide
  Saccharomycetes
gtaggtgaacctgcggaaggatcattaacattaatttactacacactgtttttttacaacaaaaaaaatctatctaaaaacaattctttacaagaaattcttaaaactttcaacaacggatctcttggttctcgcatcgatgaagaacgca

SEQ ID NO: 2932 - DNA, 151 bp, Unknown
  Description of Unknown: fungal polynucleotide
  Saccharomycetes; Incertae sedis
gtaggtgaacctgcggaaggatcattaaaaaatattattacacacagtttttatttaaacaaactaattgatataaatctactttttaattttattaaaactttcaacaacggatctcttggttctcgcatcgatgaagaacgcagcatct

SEQ ID NO: 2933 - DNA, 151 bp, Debaryomyces prosopidis
  Saccharomycetes; Incertae sedis; Debaryomyces Debaryomyces prosopidis
gtaggtgaacctgcggaaggatcattacagtattctttttgccagcgcttaattgcgcggcgaaaaaaccttacacacagtgttttttgttattacaagaacttttgctttggtctggactagaaatagtttgggccagaggtttactgaa

SEQ ID NO: 2934 - DNA, 151 bp, Candida sp.
  Saccharomycetes; Incertae sedis; Candida Candida sp CBS 10854
gtaggtgaacctgcggaaggatcattacagtttttgcgtgtgcttaagtgcaccgcatgtccacactgtgcgtacgccacgaatatctccgggggcgcgagcctccggacgtacactcaaccaacggttttgcagcagtcatgaataacca

SEQ ID NO: 2935 - DNA, 151 bp, Geotrichum candidum
  Saccharomycetes; Dipodascaceae; Geotrichum Geotrichum candidum
gtaggtgaacctgcggaaggatcattaagaattgataatatttgtgaaatttacacagcaaacaataatcatacaatcaaaacaaaaataatcaaaacttttaacaatggatctcttggttctcgcatcgatgaagaacgcagcatctgac

SEQ ID NO: 2936 - DNA, 151 bp, Pichia fermentans
  Saccharomycetes; Pichiaceae; Pichia Pichia fermentans
gtaggtgaacctgcggaaggatcattactgtgatttatatcttatacacatgcgtgagcgcaccaaacacctaaaattgtaataataccagtcactaagttttaacaaaacaaaactttcaacaacggatctcttggttctcgcatcgatg

SEQ ID NO: 2937 - DNA, 151 bp, Pichia fermentans
  Saccharomycetes; Pichiaceae; Pichia Pichia fermentans
gtaggtgaacctgcggaaggatcattactgtgatttatatcttatacacatgcgtgagcgcaccaaacacctaaaattgtaatactaattgtcagtaagttttaacaaaacaaaactttcaacaacggatctcttggttctcgcatcgatg

SEQ ID NO: 2938 - DNA, 151 bp, Unknown
  Description of Unknown: fungal polynucleotide
  Saccharomycetes; Dipodascaceae
gtaggtgaacctgcggaaggatcattaagaattataaatatttgtgaaatttacacagcaaacaataattttatagtcaaaacaaaaataatcaaaacttttaacaatggatctcttggttctcgcatcgatgaagaacgcagcatctgac

SEQ ID NO: 2939 - DNA, 151 bp, Pichia fermentans
  Saccharomycetes; Pichiaceae; Pichia Pichia fermentans
gtaggtgaacctgcggaaggatcattactgtgatttatatcttatacacatgcgtgagcgcaccaaacacctaaaattgtaatactaccagtcactaagttttaataaacaaaactttcaacaacggatctcttggttctcgcatcgtgaa

SEQ ID NO: 2940 - DNA, 151 bp, Unknown
  Description of Unknown: fungal polynucleotide
  Saccharomycetes; Dipodascaceae; unidentified Dipodascaceae sp
gtaggtgaacctgcggaaggatcattaagaattgataatatttgtgaaatttatacagcaaacaataattttataatcaacaccaaaaaaattaaaacttttaacaatggatctcttggttctcgcatcgatgaagaacgcagcatctgac

SEQ ID NO: 2941 - DNA, 151 bp, Issatchenkia orientalis
  Saccharomycetes; Pichiaceae; Issatchenkia Issatchenkia orientalis
gtaggtgaacctgcggaaggatcattactgtgatttagtactacactgcgtgagcggaacgaaaacaaaaacacctaaaatgtggaatatagcatagtcgacaagagaaatctacgaaaaacaaacaaaactttcaacaacggatctcttg

SEQ ID NO: 2942 - DNA, 151 bp, Pichia fermentans
  Saccharomycetes; Pichiaceae; Pichia Pichia fermentans
gtaggtgaacctgcggaaggatcattactgtgatttatatcttatacacatgcgtgagcgcaccaaacacctaaaattgtaataccaccagtcagtaagttttaacaaaacaagactttcaacgacggatctcttggttctcgcatcgatg

SEQ ID NO: 2943 - DNA, 151 bp, Issatchenkia orientalis
  Saccharomycetes; Pichiaceae; Issatchenkia Issatchenkia orientalis
gtaggtgaacctgcggaaggatcattactgtgatttactactacactgcgtgagcggaacgaaaacaacaacacctaaaatgtggaatatagcatatagtcgacaagagaaatctacgaaaaaacaaacaaaactttcaacaacggatctc

SEQ ID NO: 2944 - DNA, 151 bp, Hanseniaspora uvarum
  Saccharomycetes; Saccharomycodaceae; Hanseniaspora Hanseniaspora uvarum
gtaggtgaacctgcggaaggatcattagattgaattatcattgttgctcgagttcttgtttagatcttttacaataatgtgtatctttattggagatgtgcgcttaattgcgctgcttcattagagtgtcgcagtagaagtagtcttgctt

SEQ ID NO: 2945 - DNA, 151 bp, Geotrichum candidum
  Saccharomycetes; Dipodascaceae; Geotrichum Geotrichum candidum
gtaggtgaacctgcggaaggatcattaagaattgataatatttgtgaaatttacacagcaaacaataattttatagtcaaaacaaaaataatcaaaacttttaacaatggatctcttggttctcgcatcgatgaagaacgcagcatctact

SEQ ID NO: 2946 - DNA, 151 bp, Kluyveromyces marxianus
  Saccharomycetes; Saccharomycetaceae; Kluyveromyces Kluyveromyces marxianus
gtaggtgaacctgcggaaggatcattaaagattatgaatgaatagattactgggggaatcgtctgaacaaggcctgcgcttaattgcgcggccagttcttgattctctgctatcagttttctatttctcatcctaaacacaatggagtttt

SEQ ID NO: 2947 - DNA, 151 bp, Geotrichum candidum
  Saccharomycetes; Dipodascaceae; Geotrichum Geotrichum candidum
gtaggtgaacctgcggaaggatcattaagaattgataatatttgtgaaatttacacagcaaacaataattttatagtcaaaacaaaaataatcaaaactttcaacaacggatctcttggttctcgcatcgatgaagaacgcagcatctgac

SEQ ID NO: 2948 - DNA, 151 bp, Unknown
  Description of Unknown: fungal polynucleotide
  Saccharomycetes; Dipodascaceae; unidentified
gtaggtgaacctgcggaaggatcattaagaattataaatatttgtgaaatttacacagcaaacaataattttatagtcaaaacaaaaaaattaaaacctttaacaatggatctcttggttctcgcatcgatgaagaacgcagcatctgact

SEQ ID NO: 2949 - DNA, 151 bp, Pichia fermentans
  Saccharomycetes; Pichiaceae; Pichia Pichia fermentans
gtaggtgaacctgcggaaggatcattactgtgatttatatcttatacacatgcgtgagcgcaccgaacacctaaaattgtaatactaccagtcgctaagttttaataaacaaaactttcaacaacggatctcttggttctcgcatcgatga

SEQ ID NO: 2950 - DNA, 151 bp, Geotrichum candidum
  Saccharomycetes; Dipodascaceae; Geotrichum Geotrichum candidum
gtaggtgaacctgcggaaggatcattaagaattgataatatttgtgaaatttgcacagcaaacaataattttatagtcaaaacaaaaataatcaaaacttttaacaatggatctcttggttctcgcatcggaagaacgcagcatctgactg

SEQ ID NO: 2951 - DNA, 151 bp, Geotrichum candidum
  Saccharomycetes; Dipodascaceae; Geotrichum Geotrichum candidum
gtaggtgaacctgcggaaggatcattaagaattgataatatttgtgaaatttatacaaacaacaacaatcatacaatcaaaacaaaaataatcaaaacttttaacaatggatctcttggttctcgcatcgatgaagaacgcagcatctgac

SEQ ID NO: 2952 - DNA, 151 bp, Geotrichum candidum
  Saccharomycetes; Dipodascaceae; Geotrichum Geotrichum candidum
gtaggtgaacctgcggaaggatcattaagaattgataatatttgtgaaatttacacagcaaacaataatcatacaatcaaaacaaaaataatcaaaacttttaacaatggatctcttggttctcgcatcgatgaagaacgcagcagcatct

SEQ ID NO: 2953 - DNA, 151 bp, Geotrichum candidum
  Saccharomycetes; Dipodascaceae; Geotrichum Geotrichum candidum
gtaggtgaacctgcagaaggatcattaagaattgaaaatatttgtgaaatttatacagcaaacaataatcatacaatcaaaacaaaaaaattaaaacttttaacaatggatctcttggttctcgcatcgatgaagaacgcagcatctgact

SEQ ID NO: 2954 - DNA, 151 bp, Geotrichum candidum
  Saccharomycetes; Dipodascaceae; Geotrichum Geotrichum candidum
gtaggtgaacttgcggaaggatcattaagaattgataatatttgtgaaatttacacagcaaacaataattttatagtcaaaacaaaaataatcaaaactcttaacaatggatctcttggttctcgcatcgatgaagaacgcagcttctgac

SEQ ID NO: 2955 - DNA, 151 bp, Wickerhamomyces sp.
  Saccharomycetes; Incertae sedis; Wickerhamomyces Wickerhamomyces sp LCF_22
gtaggtgaacctgcggaaggatcatttttgaatctggtctcagcgcttaactgcgcgggactaaaccttcacacttgtttatttattaactactatcagtcgagcgtgagctcggctgtataataactctaagatctaatcttaacttaac

SEQ ID NO: 2956 - DNA, 151 bp, Unknown
  Description of Unknown: fungal polynucleotide
  Saccharomycetes
gtaggtgaacctgcggaaggatcatttttgaatctggtctcagcgcttaactgcgcgggactaaaccttcacacttgtttattgtaatactgtcagacgagcgtgagctcggctgtaacacacaactctaagatctaatcttaacttaaca

SEQ ID NO: 2957 - DNA, 151 bp, Wickerhamomyces sp.
  Saccharomycetes; Incertae sedis; Wickerhamomyces Wickerhamomyces sp LCF_22
gtaggtgaacctgcggaaggatcatttttgaatctggtctcagcgcttaactgcgcgggactaaaccttcacacttgtttattgtaatactctcagtcgagcgcgagctcggctgtataataactctaagatccaatcttaacttaacact

SEQ ID NO: 2958 - DNA, 151 bp, Geotrichum candidum
  Saccharomycetes; Dipodascaceae; Geotrichum Geotrichum candidum
gtaggtgaacctgcggaaggatcattaagaattgataatatttgtgaaatctacacagcaaacaataatcatacaatcaaagcaaaaataatcaaaacttttaacaatggatctcttggttctcgcatcgatgaagaacgcagcatctact

SEQ ID NO: 2959 - DNA, 151 bp, Hanseniaspora thailandica
  Saccharomycetes; Saccharomycodaceae; Hanseniaspora Hanseniaspora thailandica
gtaggtgaacctgcggaaggatcattagattgaattatcattgttgctcgagttctagttttagatcttttacaataatgtgtatctttattgaagatgtgcgcttaattgcgctgcttctttaaagtgtcgcagtagaagtaatcttgct

SEQ ID NO: 2960 - DNA, 151 bp, Geotrichum candidum
  Saccharomycetes; Dipodascaceae; Geotrichum Geotrichum candidum
gtaggcgaacctgcggagggatcattaagaattgataatatttgtgaaatttacacagcaaacaataattttatagtcaaaacaaaaataatcaaaacttttaacaatggatctcttggttcttgcatcgatgaagaacgcagcatctgac

SEQ ID NO: 2961 - DNA, 151 bp, Geotrichum candidum
  Saccharomycetes; Dipodascaceae; Geotrichum Geotrichum candidum
gtaggtgaacccgcagaaggatcattaagaattgataatacttgtgaaatttacacagcaaacaataattttatagtcaaaacaaaaataatcaaaacttttaacaatggatctcttggttctcgcatcgatgaagaacgcagcatctgac

SEQ ID NO: 2962 - DNA, 151 bp, Pichia fermentans
  Saccharomycetes; Pichiaceae; Pichia Pichia fermentans
ataggtgaacctggggaaggatcattactgtgatttatatcttatacacacgcgtgagcgcatcaaacacctaaaattgtaataataccagtcactaagttttaacaaaacaaaactttcaacaacggatctctcggttctcgcatcgatg

SEQ ID NO: 2963 - DNA, 151 bp, Geotrichum sp.
  Saccharomycetes; Dipodascaceae; Geotrichum
gtaggagaacctgcggaaggatcattaagaattataaaaatttgtgaaatttacacagcaaacaataattagatagtcaaaacaaaaaaattaaaacttttaacaatggaactcttggttctcgcatagatgaagaacgcagcatctgact

SEQ ID NO: 2964 - DNA, 151 bp, Geotrichum candidum
  Saccharomycetes; Dipodascaceae; Geotrichum Geotrichum candidum
gtaggagaacctgcggaaggatcattaagaaatataaatatttgtgaaatttacacagcaaacaataatttgatagtcaaaacaaaaataatgaaaacttctaacaatggatctcttggttctcgcatcgatgaagaacgcagcatctgac

SEQ ID NO: 2965 - DNA, 151 bp, Acremonium sp.
  Sordariomycetes; Incertae sedis; Acremonium Acremonium sp 2 J12
gttggtgaaccagcggagggatcattaccagagtgccctaggctctccaacccattgtgaacatacctaacgttccctcggcgggctcagcgcgcggtgcctccgggctccgggcgtccgccggggacaaccaaaccctgattttatcgtg

SEQ ID NO: 2966 - DNA, 151 bp, Gibberella intricans
  Sordariomycetes; Nectriaceae; Gibberella Gibberella intricans
gttggtgaaccagcggagggatcattaccgagtttacaactcccaaacccctgtgaacatacctatacgttgcctcggcggatcagcccgcgccccgtaaaacgggacggcccgcccgaggacccctaaactctgtttttagtggaacttc

SEQ ID NO: 2967 - DNA, 151 bp, Gibberella intricans
  Sordariomycetes; Nectriaceae; Gibberella Gibberella intricans
gttggtgaaccagcggagggatcattaccgagtttacaactcccaaacccctgtgaacatacctatacgttgcctcggcggatcagcccgcgccctgtaaaaagggacggcccgcccgcggaccctaaactctgtttttagtggcactcct

SEQ ID NO: 2968 - DNA, 151 bp, Fusarium culmorum
  Sordariomycetes; Nectriaceae; Fusarium Fusarium culmorum
gttggtgaaccagcggagggatcattaccgagtttacaactcccaaacccctgtgaacataccttatgttgcctcggcggatcagcccgcgccccgtaaaaagggacggcccgccgcaggaaccctaaactctgtttttagtggaacttct

SEQ ID NO: 2969 - DNA, 151 bp, Unknown
  Description of Unknown: fungal polynucleotide
  Sordariomycetes
gttggtgaaccagcggagggatcattagagaatttggctcggttatattatttttctgttttgtataaaactttcagcaacggatctcttggctcaggcatcgatgaagaacgcagcatctgactgactgaggccatcagtatctcgtatg

SEQ ID NO: 2970 - DNA, 151 bp, Unknown
  Description of Unknown: fungal polynucleotide
  Sordariomycetes
gttggtgaaccagcggagggatcattaccagagtgccctaggctctccaacccattgtgaacatacctatcgttccctcggcgggctccacgcccggtgcctccgggctccgggcgtccgcccgggacaaccaaaccctgattttatcgtg

SEQ ID NO: 2971 - DNA, 151 bp, Acremonium sp.
  Sordariomycetes; Incertae sedis; Acremonium Acremonium sp 2 J12
gttggtgaaccagcggagggatcattaccagagtgccctaggctctccaacccattgtgaacatacctatcgttccctcggcgggctcagcgcgcggtgcctccgggctcccggcgtccgccggggacaaccaaaccctgattttttcttt

SEQ ID NO: 2972 - DNA, 151 bp, Acremonium zeae
  Sordariomycetes; Incertae sedis; Acremonium Acremonium zeae
gttggtgaaccagcggagggatcattaccagagtgccctgggctctccaacccattgtgaacatacctaacgttccctcggcgggctccgcgcggtgcctccgggctccgggcgtccgccggggacaagcaaaccctgattttatcgtgta

SEQ ID NO: 2973 - DNA, 151 bp, Fusarium poae
  Sordariomycetes; Nectriaceae; Fusarium Fusarium poae
gttggtgaaccagcggagggatcattaccgagtttacaactcccaaacccctgtgaacataccatatgttgcctcggcggatcagcccgtccttcgggacggcccgccgcagggccctaaactctgtttttagtggaacttctgagtaaaa

SEQ ID NO: 2974 - DNA, 151 bp, Fusarium sp.
  Sordariomycetes; Nectriaceae; Fusarium
gtcggtgaaccagcggagggatcattaccgagtttacaactcccatacccctgtgaacataccaattgttgcctcggcggatcagcccgctcccggtaaaacgggacggcccgccagaggacccctcccctctgtttctatatgtaacttc

SEQ ID NO: 2975 - DNA, 151 bp, Gibberella intricans
  Sordariomycetes; Nectriaceae; Gibberella Gibberella intricans
gttggtgaaccagcggagggatcattaccgagtttacaactcccaaacccctgtgaacatacctatacgttacctcggcggatcagcccgcgccctgtgaaaagggacggcccgcccgaggaccctaagctctgtttttagtggaacttct

SEQ ID NO: 2976 - DNA, 151 bp, Fusarium culmorum
  Sordariomycetes; Nectriaceae; Fusarium Fusarium culmorum
gttggtgaaccagcggagggatcattaccgagtttacaactcccaaacccctgtgaacataccttatgttgcctcggcggatcagcccgcgccccgtaaaaagggacggcccgccgcaggaaccctaaactctgtttttagtggagaacgc

SEQ ID NO: 2977 - DNA, 151 bp, Monographella cucumerina
  Sordariomycetes; Incertae sedis; Monographella Monographella cucumerina
gttggtgaaccagcggagggatcattactgagtactacactctctaccctttgtgaactattatacctgttgcttcggcggcgcccgcaagggtgcccgccggtctcatcagaatctctgttttcgaacccgacgatacttctgagtgttc

SEQ ID NO: 2978 - DNA, 151 bp, Unknown
  Description of Unknown: fungal polynucleotide
  Sordariomycetes
gttggtgaaccagcggagggatcattaccagagtgccttttggctctccaacccactgtgaacatacctacgtttccctcggcgggctcagcgcgttgcggttccgccgcctcgcgtccgccgggggcacccaaactcgaatttatatcgt

SEQ ID NO: 2979 - DNA, 151 bp, Gibberella intricans
  Sordariomycetes; Nectriaceae; Gibberella Gibberella intricans
gttggtgaaccagcggagggatcattaccgagtttacaactcccaaacccctgtgaacatacctatacgttgcctcggcggatcagcccgcgccccgtaaaacgggacggcccgcccgaggacccctaaactctgtttttgtgggaccttt

SEQ ID NO: 2980 - DNA, 151 bp, Khuskia oryzae
  Sordariomycetes; Incertae sedis; Khuskia Khuskia oryzae
gttggtgaaccagcggagggatcattacagagttatccaactcccaaacccatgtgaacttatctctttgttgcctcggcgcaagctacccgggacccagcgccccgggcggcccgccggcggacaaaccaaactcttgttatcttagttg

SEQ ID NO: 2981 - DNA, 151 bp, Diaporthe sp.
  Sordariomycetes; Diaporthaceae; Diaporthe
gttggtgaaccagcggagggatcattgctggaacgcgccccaggcgcacccagaaaccctttgtgaacttatacctgactgttgcctcggcacaggccggccccccatggggggcccctcggagacgaggagcaggcccgccggcggccaa

SEQ ID NO: 2982 - DNA, 151 bp, Acremonium sp.
  Sordariomycetes; Incertae sedis; Acremonium Acremonium sp MAB_2010l
gttggtgaaccagcggagggatcattaccagagtgccctaggctctccaacccattgtgaacttaccaaacgttccctcggcgggctcagcgcgcggtggcctccgggcctccgggcgtccgccggggaaaaccaaaccctgatttaatcg

SEQ ID NO: 2983 - DNA, 151 bp, Gibberella intricans
  Sordariomycetes; Nectriaceae; Gibberella Gibberella intricans
gtaggtgaacctgcggagggatcattaccgagtttacaactcccaaacccctgtgaacatacctatacgttgcctcggcggatcagcccgcgccctgtaaaaagggacggcccgcccgaggaccctaaactctgtttttagtggaacttct

SEQ ID NO: 2984 - DNA, 151 bp, Trichoderma sp.
  Sordariomycetes; Hypocreaceae; Trichoderma
gttggtgaaccagcggagggatcattaccgagtttacaactcccaaaccccaatgtgaacgttaccaatctgttgcctcggcgggatctctgccccgggcgcgtcgcagccccggatcccatggcgcccgccggaggaccaaccaaactct

SEQ ID NO: 2985 - DNA, 151 bp, Unknown
  Description of Unknown: fungal polynucleotide
  Sordariomycetes
gttggtgaaccagcggagggatcattagagaatttggctcggttatattatttttctgttttgtataaaactttcagcaacggatctcttggctcaggcatcgatgaagaacgcagcatctgactgactgacggaacccatatctcgtatg

SEQ ID NO: 2986 - DNA, 151 bp, Unknown
  Description of Unknown: fungal polynucleotide
  Sordariomycetes; Incertae sedis
gttggtgaaccagcggagggatcattaccgagtttacaactcccaaacccctgtgaacataccaattgttgcctcggcgggctcagcgcgcggtgcctccgggctccgggcgtccgccggggacaagcaaaccctgattttatcgtgtatc

SEQ ID NO: 2987 - DNA, 151 bp, Gibberella intricans
  Sordariomycetes; Nectriaceae; Gibberella Gibberella intricans
gttggtgaaccagcggagggatcattaccgggtttacaactcccaaacccctgtgaacatacctatacgttgcctcggcgaatcagcccgcgccctgtaaaaaaggacggcccgcccgaggacccctaaactctgtttttagtggaacttc

SEQ ID NO: 2988 - DNA, 151 bp, Hypocrea sp.
  Sordariomycetes; Hypocreaceae; Hypocrea
gttggtgaaccagcggagggatcattaccgagtttacaactcccaaacccaatgtgaacgttaccaaactgttgcctcggcgggatctctgccccgggtgcgtcgcagccccggaccaaggcgcccgccggaggaccaaccaaaactctta

SEQ ID NO: 2989 - DNA, 151 bp, Fusarium nelsonii
  Sordariomycetes; Nectriaceae; Fusarium Fusarium nelsonii
gttggtgaaccagcggagggatcattaccgagtttacaactcccaaacccctgtgaacatacctatacgttgcctcggcggatcagcccgcgccccgtaaaacgggacggcccgccgcaggacccataaaccctgaattttattgtaactt

SEQ ID NO: 2990 - DNA, 151 bp, Harzia acremonioides
  Sordariomycetes; Ceratostomataceae; Harzia Harzia acremonioides
gttggtgaaccagcggagggatcattacagaacaggcatttatgatgtcatggctctgccaaccccgcgaactttatacatgtacgttgcctcggcggacactcgaccccatctcctgccccagcccggctcgcccgggaggggggaggca

SEQ ID NO: 2991 - DNA, 151 bp, Unknown
  Description of Unknown: fungal polynucleotide
  Sordariomycetes
gttggtgaaccagcggagggatcattagagaatttggctcggttatattatttttctgttttgtataaaactttcagcaacggatctcttggctcaggcatcgatgaagaacgcagcatctgactgacttgagtcactggtatctcgtatg

SEQ ID NO: 2992 - DNA, 151 bp, Acremonium sp.
  Sordariomycetes; Incertae sedis; Acremonium Acremonium sp 4053
gttggtgaaccagcggagggatcattaccgagtgtaaaaactcccaaaccattgtgaacctaccactgttgcttcggcggcctcgccccgggcgcgttcgcgcggcccggacccaggcgtccgccggaggctccaaactcttgtcttttag

SEQ ID NO: 2993 - DNA, 151 bp, Fusarium sporotrichioides
  Sordariomycetes; Nectriaceae; Fusarium Fusarium sporotrichioides
gttggtgaaccagcggagggatcattactgagtttacaactcccaaacccctgtgaacatacctttatgctgcctcggcggatcagcccgcgccccgtaaaacgggacggcccgccgcaggaaaccctaaactctgtttttagtggaactt

SEQ ID NO: 2994 - DNA, 151 bp, Unknown
  Description of Unknown: fungal polynucleotide
  Sordariomycetes
gttggtgaaccagcggagggatcattagagaatttggctcggttatattatttttctgttttgtataaaactttcagcaacggatctcttggctcaggcatcgatgaagaacgcagcatctgactgactcgtaaccaaccaatctcgtatg

SEQ ID NO: 2995 - DNA, 151 bp, Phialemonium curvatum
  Sordariomycetes; Cephalothecaceae; Phialemonium Phialemonium curvatum
gttggtgaaccagcggagggatcattaaagagttgcaaaactcccaaaccatttgtctacctacctgtttcgttgcttcggcaggcggtcccccaggggcctttagcctaccaggtgcctgccggagtacccaaaactcttgttaattact

SEQ ID NO: 2996 - DNA, 151 bp, Gibberella intricans
  Sordariomycetes; Nectriaceae; Gibberella Gibberella intricans
gttggtgaaccagcggagggatcattaccgagtttacaactcccaaacccctgtgaacatacctatacgttgcctcggcggatcagcccgcgccctgtaaaaagggacggcccgcccgaggaccctaaactctgttcttagtggagcctct

SEQ ID NO: 2997 - DNA, 151 bp, Khuskia oryzae
  Sordariomycetes; Incertae sedis; Khuskia Khuskia oryzae
gttggtgaaccagcggagggatcattacagagttatccaactcccaaacccatgtgaacttatctctttgttgcctcggcgcaagctacccgggacctcgcgccccggggggcccgccggcggacaaaccaaactctgttatcttcgttga

SEQ ID NO: 2998 - DNA, 151 bp, Fusarium sp.
  Sordariomycetes; Nectriaceae; Fusarium Fusarium sp H007
gttggtgaaccagcggagggatcattaccgagtttacaactcccaaaaaactgtgaacataccaattgttgcctcggcggaacagcccgctcccggtaaaacgggacggcccgccagaggacccctaaaatctgtttctatatgtaacttc

SEQ ID NO: 2999 - DNA, 151 bp, Pyricularia sp.
  Sordariomycetes; Magnaporthaceae; Pyricularia Pyricularia sp
gtaggtgaacctgcggaaggatcattaccgagttagggttctctgaaaacgaagcccgacctcccaaccctgtgtttataccgaccactgttgcttcggcggaccgcctctcctccctgtttaccaggagggttgtgggcgccgggggcga

SEQ ID NO: 3000 - DNA, 151 bp, Unknown
  Description of Unknown: fungal polynucleotide
  Sordariomycetes; Bionectriaceae
gttggtgaaccagcggagggatcattaccgagtttacaactcccaaacccatgtgaacatacctatcgttgcttcggcggatcgccccgggcgccttgcgtgccccggatccaggcggccgccgggggaccttaactcttgtttctactga

SEQ ID NO: 3001 - DNA, 151 bp, Unknown
  Description of Unknown: fungal polynucleotide
  Sordariomycetes
gttggtgaaccagcggagggatcattagagaatttggctcggttatattatttttctgttttgtataaaactttcagcaacggatctcttggctcaggcatcgatgaagaacgcagcatctgactgactttctgggaacacatctcgtatg

SEQ ID NO: 3002 - DNA, 151 bp, Gibberella intricans
  Sordariomycetes; Nectriaceae; Gibberella Gibberella intricans
gttggtgaaccagcggagggaccattaccgagtttacgactcccaaacccctgtgaacatacctatacgttgcctcggcggatcagcccgcgccttgtaaaaagggacggcccgcccgaggaccctaaactctgtttttagtggaacttct

SEQ ID NO: 3003 - DNA, 151 bp, Unknown
  Description of Unknown: fungal polynucleotide
  Sordariomycetes; Nectriaceae
gttggttaaccagcttctttatcattaccgagtttacaactccccccccccttttaacataccaattgttgcctcttcttctcctccctctcccggtaaaacgggacggcccgccctcttcccactcccctctgtttctatatgtaacttc

SEQ ID NO: 3004 - DNA, 151 bp, Acremonium sp.
  Sordariomycetes; Incertae sedis; Acremonium Acremonium sp 2 J12
gttggtgaaccagcttatttatcattaccagagtgccctaggctctccccccccttgtgaacatacctatcgttccctcttcttgctcagcgcgcggtgcctccgggctccgggcgtcctccttttccccccaaaccctgattttatcgtg

SEQ ID NO: 3005 - DNA, 151 bp, Fusarium sp.
  Sordariomycetes; Nectriaceae; Fusarium Fusarium sp H007
gttggtgaaccagcttctttatcattaccgagtttacaactcccccccccctttgaacataccaattgttgcctcgtcttctccgcccgctcccggtaaaacgggacggcccgccctcttccccctcccctctgtttctatatgtaacttc

SEQ ID NO: 3006 - DNA, 151 bp, Fusarium sp.
  Sordariomycetes; Nectriaceae; Fusarium
gttggtgaaccagctgagtgatcattaccgagtttacaactcccaaccccctttgaacataccaattgttgcctcgtcttatcagcccgctcccggtaaaacgggacggcccgccagctgacccctcccctctgtttctatatgtaacttc

SEQ ID NO: 3007 - DNA, 151 bp, Unknown
  Description of Unknown: fungal polynucleotide
  Sordariomycetes
gttggtgaaccagctgagtgatcattaccagagtgccctaggctctcccccccattgtgaacatacctatcgttccctctgctggctcagcgcgcggtgcctccgggctccgggcgtccgccgtttccccccaaaccctgattttatcgtg

SEQ ID NO: 3008 - DNA, 151 bp, Acremonium sp.
  Sordariomycetes; Incertae sedis; Acremonium Acremonium sp 2 J12
tttggtgaaccagctgagggatcattaccagagtgccctaggctctccccccccttgtgaacatacctaacgttccctcggcgggctcagcgcgcggtgcctccgggctccgggcgtccgccgtgtccccccaaaccctgattttatcgtg

SEQ ID NO: 3009 - DNA, 151 bp, Fusarium sp.
  Sordariomycetes; Nectriaceae; Fusarium
tttggtgaaccagctgagggatcattaccgagtttacaactcccaaccccctttgaacataccaattgttgcctcggcggatcagcccgctcccggtaaaacgggacggcccgccagcggacccctcccctctgtttctatatgtaacttc

SEQ ID NO: 3010 - DNA, 151 bp, Acremonium sp.
  Sordariomycetes; Incertae sedis; Acremonium Acremonium sp 2 J12
tttggtgaaccagcggagggatcattaccagagtgccctaggctctccaacccattgtgaacatacctatcgttccctcggcgggctcagcgcgcggtgcctccgggctccgggcgtccgccgtgtacccccaaaccctgattttatcgtg

SEQ ID NO: 3011 - DNA, 151 bp, Fusarium sp.
  Sordariomycetes; Nectriaceae; Fusarium
gttggtgaaccagctgagggatcattaccgagtttacaactcccaaccccctttgaacataccaattgttgcctcggcggatcagcccgctcccggtaaaacgggacggcccgccagctgacccctaaactctgtttctatatgtaacttc

SEQ ID NO: 3012 - DNA, 151 bp, Unknown
  Description of Unknown: fungal polynucleotide
  Sordariomycetes; Nectriaceae
gttggtgaaccagcggagggatcattaccgagtttacaactcccacccccctgtgaacatacctatacgttgcctcggcggatcagcccgcgccccgtaaaacgggacggcccgccctaggacccctcccctctgtttttagtggaacttc

SEQ ID NO: 3013 - DNA, 151 bp, Gibberella intricans
  Sordariomycetes; Nectriaceae; Gibberella Gibberella intricans
gttggtgaaccagcggagggatcattaccgagtttacaactcccaaacccctgtgaacatacctatacgttgcctcggcgtatcagcccgtgccctgtaaaagggacggcccgcccgaggaccctaaactctgtttttagtggaacttctg

SEQ ID NO: 3014 - DNA, 151 bp, Eutypella scoparia
  Sordariomycetes; Diatrypaceae; Eutypella Eutypella scoparia
gttggtgaaccagcggagggatcattactgagttttctaaactcccaaccctttgcgaacatacctttgttgccttggcggaagcgccgccctggaacggcctaccctgtagtgtcccgccctgggagtcgcccgtcgaaggacccccaaa

SEQ ID NO: 3015 - DNA, 151 bp, Harzia acremonioides
  Sordariomycetes; Ceratostomataceae; Harzia Harzia acremonioides
gttggtgaaccagcggagggatcattacagaatctggcattaactatgtcatggctctgccaaccccgcgaactttatacatgtacgttgcctcggcggacacttgaccttctcccgacccaccccggctcacccgggaggagggtggagg

SEQ ID NO: 3016 - DNA, 151 bp, Fusarium sp.
  Sordariomycetes; Nectriaceae; Fusarium
gttggtgaaccagcggagggatcattaccgagtttacaactcccaaacccctgtgaacataccatatgttgcctcggcggaccagcccgtcctacgggacggcccgcccgaggacccctaaactctgtttttagtggaacttctgagtaaa

SEQ ID NO: 3017 - DNA, 151 bp, Acremonium tubakii
  Sordariomycetes; Incertae sedis; Acremonium Acremonium tubakii
gttggtgaaccagcggagggatcattactgagtgtaaaaactcccaaaccctatgtgaacctaccacagttgcttcggcggcctaaatcgccccgggcgccccagcgcgccccggacccaggcgaccgccggaggcaccaaactctgaatc

SEQ ID NO: 3018 - DNA, 151 bp, Myrmecridium phragmitis
  Sordariomycetes; Incertae sedis; Myrmecridium Myrmecridium phragmitis
gttggtgaaccagcggagggatcattacgagagtgtcaccactcccaacccattgtttacctacccgtccaccgtgcttcggcaggcagccctgtgggacagagcctcgcccccttcgcggggggtgcctgccgctggccaaccaacaaac

SEQ ID NO: 3019 - DNA, 151 bp, Fusarium sp.
  Sordariomycetes; Nectriaceae; Fusarium Fusarium sp 472
gttggtgaaccagcggagggatcatcaccgagtttacaactcccaaaccccggtggacatacctatacgttgcctcggcggatcagcccgcgccccgtaaaaagggacggcccgcccgaggacccctaaactctgttttcagtggaacttc

SEQ ID NO: 3020 - DNA, 151 bp, Myrothecium sp.
  Sordariomycetes; Incertae sedis; Myrothecium Myrothecium sp
gttggtgaaccagcggagggatcattaccgagtttacaactcccaaaccctttgtgaaccttaccatatcgttgcttcggcgggtctcgccccggcgcccccgggcccggaaccaggcgcccgccggagaccccaaactctcatgtctttt

SEQ ID NO: 3021 - DNA, 151 bp, Sphaeronaemella helvellae
  Sordariomycetes; Incertae sedis; Sphaeronaemella Sphaeronaemella helvellae
gttggtgaaccagcggagggatcattagagaatttggctcggttatattatttttctgttttgtataaaactttcagcaacggatctcttggctcaggcatcgatgaagaacgcagcatctgactgactttcgcccttcagatctcgtatg

SEQ ID NO: 3022 - DNA, 151 bp, Acremonium sp.
  Sordariomycetes; Incertae sedis; Acremonium Acremonium sp 1 C17
gttggtgaaccagcggagggatcattaccagagagccttttggcactccaacccattgtgaacatacctacgtttccctcggcgggctcagcgcgaggcggtcttccgccctcgcgtccgccgggggcacccaaactcgaatttatatcgt

SEQ ID NO: 3023 - DNA, 151 bp, Gibberella baccata
  Sordariomycetes; Nectriaceae; Gibberella Gibberella baccata
gttggtgaaccagcggagggatcattaccgagtttacaactcccaaacccctgtgaacataccttaatgttgcctcggcggatcagcccgcgccccgtaaaacgggacggcccgccagaggacccaaactctaatgtttcttattgtaact

SEQ ID NO: 3024 - DNA, 151 bp, Trichothecium roseum
  Sordariomycetes; Incertae sedis; Trichothecium Trichothecium roseum
gttggtgaaccagcggagggatcattatagagttaacaaaacaactcccaaccctttgtgaaccttacctaccgttgcttcggcggaccgccccgggcgctgcgtgccccggacccaaggcgcccgccggggaccacacgaaccctgttta

SEQ ID NO: 3025 - DNA, 151 bp, Unknown
  Description of Unknown: fungal polynucleotide
  Sordariomycetes
gttggtgaaccagcggagggatcattaccgagtacaactcgccaacccactgtgaacatacctcagttgcttcggcggacccgccccggcgccctcgggcccggaccaggcgcccgccggaggaccccaaaccactgaattaccatgtgta

SEQ ID NO: 3026 - DNA, 151 bp, Verticillium dahliae
  Sordariomycetes; Plectosphaerellaceae; Verticillium Verticillium dahliae
gttggtgaaccagcggagggatcattaccgagtactataactcataaccctttgtgaaccttcatacctgttgcttcggcggcgcgcctctcggggcgtgcccgccggcattatcagaatctctgttcgaacccgacgatacttctgagtg

SEQ ID NO: 3027 - DNA, 151 bp, Cosmospora sp.
  Sordariomycetes; Nectriaceae; Cosmospora Cosmospora sp
gtaggtgaacctgcggagggataattacaagtgaccccggtctaacaaaagggatgttcataaccctttgttgtccgactcggttgcctccggggcgaccctgccttcgggcgggggctccgggtggagacttcaaactcttgcgtaactt

SEQ ID NO: 3028 - DNA, 151 bp, Unknown
  Description of Unknown: fungal polynucleotide
  Sordariomycetes; Nectriaceae
gttggtgaaccagcggagggataattaccgagtttacaactcccaaagaactgtgaacataccgatacgttgcctcggcggaacagcccgcgccccgtaaaacgggacggcccgcccgaggacccctaaactctgtttttagtggaacttc

SEQ ID NO: 3029 - DNA, 151 bp, Diaporthe longicolla
  Sordariomycetes; Diaporthaceae; Diaporthe Diaporthe longicolla
gttggtgaaccagcggagggatcattgctggaacgcgcctcggcgcacccagaaaccctttgtgaacttatacctactgttgcctcggcgcaggccggcctttgtcaaagaaggccccctggagacagggagcagcccgccggcggccaac

SEQ ID NO: 3030 - DNA, 151 bp, Fusarium sp.
  Sordariomycetes; Nectriaceae; Fusarium
gttttttcccccgcgtctttctccttcccgattttacccctcccccccccccgttcccatacctatacgttgcctcttcttctcctccctcgccccgtaaaacgggacggccctccctcttccacataaactctgtttttagtggaacttc

SEQ ID NO: 3031 - DNA, 151 bp, Unknown
  Description of Unknown: fungal polynucleotide
  Sordariomycetes; Nectriaceae
tttggtgaaccagctgagggatcattaccgagtttacaactcccaaccccctttgaacatacctatacgttgcctcggcggatcagcccgcgccccgtaaaacgggacggcccgccctcggacccctcccctctgtttttagtggaacttc

SEQ ID NO: 3032 - DNA, 151 bp, Cosmospora sp.
  Sordariomycetes; Nectriaceae; Cosmospora Cosmospora sp
ttcggtgaacctgctgagggatcattacaagtgaccccggtctcacccccgttatgttcataaccctttgttgtccgactctgttgcctccggggcgaccctgccttcgggcgggggctccggttttccccttcaaactcttgcgtaactt

SEQ ID NO: 3033 - DNA, 151 bp, Fusarium sp.
  Sordariomycetes; Nectriaceae; Fusarium Fusarium sp H007
gttggtgaaccagcggagggatcattaccgagtttacaactcccaaacccctgtgaagatacaaattgttgcctcggcggatcagcccgctcccggtaaaacgggacggaaagccagaggacccctaaactctgtttctatatgtaaattc

SEQ ID NO: 3034 - DNA, 151 bp, Glomerella graminicola
  Sordariomycetes; Glomerellaceae; Glomerella Glomerella graminicola
gttggtgaaccagcggagggatcattactgagttaccgctctataaccctttgtgaacatacctaaccgttgcttcggcgggttagggggtcccctctccgggggacgccctcccggccgggccccactgcggggctcggcgcccgccggg

SEQ ID NO: 3035 - DNA, 151 bp, Fusarium sp.
  Sordariomycetes; Nectriaceae; Fusarium
gttggtgaaccagcggagggatcattaccgagtttacaactcccaaacccctgtgaacataccccttgttgcctcggcggatcagcccgctcccggtcaaactttaagtcccgccagaggacccctaaactctgtttctatatgtaacttc

SEQ ID NO: 3036 - DNA, 151 bp, Glomerella graminicola
  Sordariomycetes; Glomerellaceae; Glomerella Glomerella graminicola
gttggtgaaccagcggagggatcattactgagttaccgctctataaccctttgtgaacatacctaactgttgcttcggcgggcagggggtcccctcggggacgccctcccggccacgcccttcacggggcgaggcgcccgccggaggatac

SEQ ID NO: 3037 - DNA, 151 bp, Fusarium sp.
  Sordariomycetes; Nectriaceae; Fusarium
gttggtgaaccagcggagggatcattaccgagtttacaactcccaaacccctgtgaacataccttatgttgcctcggcggaccagcccgctcccggtaaaacgggacggcccgccagaggatccctaaactctgtttctatatgtaacttc

SEQ ID NO: 3038 - DNA, 151 bp, Unknown
  Description of Unknown: fungal polynucleotide
  Sordariomycetes; Nectriaceae
gttggtgcccccgcttctttctccttcccgagtttacacctcccccccccctttgcccataccaattgttgcctcgtcttctcctccctctcccggtaaaacgggacggcccgccctcttccctctcccctctgtttctatatgtaacttc

SEQ ID NO: 3039 - DNA, 151 bp, Fusarium culmorum
  Sordariomycetes; Nectriaceae; Fusarium Fusarium culmorum
attggtgaaccagcggagggatcattaccgagtttacaactcccaaacccctgtgaacatactttatgtcgcttcagcggatcagcccgcgccccgtaaaaagggacggcccgccgcaggaaccctaaactctgtttttagtggaacttct

SEQ ID NO: 3040 - DNA, 151 bp, Unknown
  Description of Unknown: fungal polynucleotide
  Sordariomycetes; Nectriaceae
tttggtgcccccgcttctttctccttcccgagtttacccctccccccccccttttcccataccaattgttgcctcgtcttctcctcccgctcccggtaaaacgggacggcccgccctcttccccctcccctctgtttctatatgtaacttc

SEQ ID NO: 3041 - DNA, 151 bp, Fusarium culmorum
  Sordariomycetes; Nectriaceae; Fusarium Fusarium culmorum
gttggtgaaccagcggagggataattaccgagtttacaactcccaaaaaactgtgaacataccttatgttgcctcggcggaacagcccgcgccccgtaaaaagggacggcccgccgcaggaaccctaaaatctgtttttagtggaacttct

SEQ ID NO: 3042 - DNA, 151 bp, Acremonium sp.
  Sordariomycetes; Incertae sedis; Acremonium
tttggtgaaccagcggagggatcattaccagagtgccctaggctctcccacccattgtgaacatacctaacgttccctcggcgggctcagcgcgcggtgcctccgggctccgggcgtccgccctttccccccaaaccctgattttatcgtg

SEQ ID NO: 3043 - DNA, 151 bp, Fusarium sp.
  Sordariomycetes; Nectriaceae; Fusarium Fusarium sp H007
gttggtgaaccagcggagggagaattaccgagtttacaactcccaaaaaactgtgaacataccaattgttgcctcggcggaacagcccgctcccggtaaaaagggacggcccgcaagaggacccctaaactctgtttctatatgtaacttc

SEQ ID NO: 3044 - DNA, 151 bp, Fusarium culmorum
  Sordariomycetes; Nectriaceae; Fusarium Fusarium culmorum
tttggtgaaccagctgagggatcattaccgagtttacaactcccaaccccctttgaacataccttatgttgcctcggcggatcagcccgcgccccgtaaaaagggacggcccgccgccggaaccctcccctctgtttttagtggcacttct

SEQ ID NO: 3045 - DNA, 151 bp, Fusarium sp.
  Sordariomycetes; Nectriaceae; Fusarium Fusarium sp H007
tttggtgaaccagcggagggatcattaccgagtttacaactcccacccccctgtgaacataccaattgttgcctcggcggatcagcccgctcccggtaaaacgggacggcccgccatctgacccctcccctctgtttctatatgtaacttc

SEQ ID NO: 3046 - DNA, 151 bp, Unknown
  Description of Unknown: fungal polynucleotide
  Sordariomycetes; Nectriaceae
gttggttcccccgcttctttctccttcccgattttacccctccccccccccttttcccataccaattgttgcctcttcttctcctccctctcccggtaaaacgggacggcccgccctcttccctctcccctctgtttctatatgtaacttc

SEQ ID NO: 3047 - DNA, 151 bp, Fusarium sp.
  Sordariomycetes; Nectriaceae; Fusarium Fusarium sp H007
tttggtgaaccagcttcttgatcattaccgattttacaactcccaccccccttttaacataccaattgttgcctcgtcttctcagcccgctcccggtaaaacgggacggcccgccctcttccccctcccctctgtttctatatgtaacttc

SEQ ID NO: 3048 - DNA, 151 bp, Acremonium zeae
  Sordariomycetes; Incertae sedis; Acremonium Acremonium zeae
tttggtgaaccagcttcttgatcattaccagagtgccctaggctctccccccccttgtgaacatacctaacgttccctcttctggctcagcgcgcggtgcctccgggctccgggcttcctccttttccccgcaaaccctgattttatcgtg

SEQ ID NO: 3049 - DNA, 151 bp, Fusarium sp.
  Sordariomycetes; Nectriaceae; Fusarium
tttggtgaaccagcttattgatcattaccgagtttacaactcccacccccctttgaacataccaattgttgcctcggcttatcagcccgctcccggtaaaacgggacggcccgccatcttacccctcccctctgtttctatatgtaacttc

SEQ ID NO: 3050 - DNA, 151 bp, Unknown
  Description of Unknown: fungal polynucleotide
  Sordariomycetes; Nectriaceae
gtttgttccccatcttctttctccttcccgcttttacccctcccccccccattttcacataccaattgttgcctcttcttctcctccctctcccggtaaaacgggacggccctccctcttccacctaaactctttttctatatgtaacttc

SEQ ID NO: 3051 - DNA, 151 bp, Eutypella alsophila
  Sordariomycetes; Diatrypaceae; Eutypella Eutypella alsophila
gttggtgaaccagcggagggatcattaatgagttttctaaactccaaacccttgagaacatacctagttgcctcggcgaacttgccctgggacgacctaccctgcagcgagttaccctgtaacgagttgccctgtagagacctgccctgta

SEQ ID NO: 3052 - DNA, 151 bp, Udeniomyces puniceus
  Tremellomycetes; Cystofilobasidiaceae; Udeniomyces Udeniomyces puniceus
gtaggtgaacctgcggaaggatcactagtgattaaacgggaagcgtcttaactgaccttctcacccttcacatccacatacaccctgtgaactgtttggcttcaactctcgagttgggctctcctatcgatagattagcaatagtctagcg

SEQ ID NO: 3053 - DNA, 151 bp, Cryptococcus albidus
  Tremellomycetes; Filobasidiaceae; Cryptococcus Cryptococcus albidus
gtaggtgaacctgcggaaggatcattaatgattgaacgtctgtcgagcttgctcacaggcacatcatatccataacacctgtgcacttgtcggatggcttagtgaagaccgcaaggttggatctatccatctactttacataacaattctg

SEQ ID NO: 3054 - DNA, 151 bp, Cryptococcus sp.
  Tremellomycetes; unidentified; unidentified uncultured Cryptococcus
gtaggtgaacctgcggaaggatcattaatgaatttagattgaaccataggcgaaagccagtggttcttctttcatatccataacacctgtgcactgttggatgcttgcatccacttttaaactaaacattattgtaacaaatgtagtctta

SEQ ID NO: 3055 - DNA, 151 bp, Cryptococcus victoriae
  Tremellomycetes; Incertae sedis; Cryptococcus Cryptococcus victoriae
gtaggtgaacctgcggaaggatcattaatagtgccctttgatgcaaatcattgggttagatctgctctcttcgcaagaagagggtttccatacacaccgtgaactgtggcttcggccatcacaaactgttagtaatgaatgtaatatcata

SEQ ID NO: 3056 - DNA, 151 bp, Cryptococcus oeirensis
  Tremellomycetes; Filobasidiaceae; Cryptococcus Cryptococcus oeirensis
gtaggtgaacctgcggaaggatcattaatgaattttaggccctagtcttaactgataagggctggttctatccataacacctgtgcactgttggatgcttgcatccacttttaaactaaacattattgtaacaaatgtagtcttattataa

SEQ ID NO: 3057 - DNA, 151 bp, Cryptococcus friedmannii
  Tremellomycetes; Filobasidiaceae; Cryptococcus Cryptococcus friedmannii
gtaggtgaacctgcggaaggatcattaatgaatacagatgcctgtcgagcttgctcacgggctttctatcatatccataacacctgtgcacttgttggatgatctaaagacatagggtaaaacctaaagtcaatagtcatccacttacact

SEQ ID NO: 3058 - DNA, 151 bp, Cryptococcus paraflavus
  Tremellomycetes; Incertae sedis; Cryptococcus Cryptococcus paraflavus
gtaggtgaacctgcggaaggatcattagtgaacgccctcacgggcttaactatccaaccaacctctgtgaaccgtcgccctcgggcgcttataacaaactataacagtcatgaacgtagtatacaaaaactaaacacaactttcaacaacg

SEQ ID NO: 3059 - DNA, 151 bp, Cryptococcus sp.
  Tremellomycetes; Filobasidiaceae; Cryptococcus
gtaggtgaacctgcggaaggatcattattgaattcaaatcatctgtggcttcggtccggatgtgccaacaggtaacactgttggtaattctatccataacacctgtgaactgttggatgcttgcatccacttttatactaaacattattgt

SEQ ID NO: 3060 - DNA, 151 bp, Cryptococcus flavus
  Tremellomycetes; Filobasidiaceae; Cryptococcus Cryptococcus flavus
gtaggtgaacctgcggaaggatcattagtgaatgccctcacgggcttaactatccaaccaacctctgtgaaccgtcgccctcgggcgcttctataacaaactataactgtcatgaacgtcgtatacaaaaactaaacacaactttcaacaa

SEQ ID NO: 3061 - DNA, 151 bp, Cryptococcus rajasthanensis
  Tremellomycetes; Incertae sedis; Cryptococcus Cryptococcus rajasthanensis
gtaggtgaacctgcggaaggatcattaaagattggccgaaaggccttatcattatatccctcacctctgtgaactgtggaccctcgggtctattttacaaacatcagtgtaatgaacgtatataacattaacaaaacaaaactttcaacaa

SEQ ID NO: 3062 - DNA, 151 bp, Cryptococcus aureus
  Tremellomycetes; Incertae sedis; Cryptococcus Cryptococcus cf aureus NRRL Y_30213
gtaggtgaacctgcggaaggatcattattgattggtcgaaagaccttatcagattctaccacctctgtgaactgttggacctccgggtctacaatcaaacatcagtgtaacgaacgtaagagtatcttaacgaaacaaaactttcaacaac

SEQ ID NO: 3063 - DNA, 151 bp, Dioszegia fristingensis
  Tremellomycetes; Incertae sedis; Dioszegia Dioszegia fristingensis
gtaggtgaacctgcggaaggatcattaataaatggcgacgctttcgagcttagcttttatatccttatacacctgtgaactatttgcctttgggcacaaacttaaacataatgtaatgaatgtaaactattataacaaatacaactttcaa

SEQ ID NO: 3064 - DNA, 151 bp, Cryptococcus paraflavus
  Tremellomycetes; Incertae sedis; Cryptococcus Cryptococcus paraflavus
gtaggtgaacctgcggaaggatcattagtgaacgccctcacgggcttaaccatccaaccaacctttgtgaaccgtcgccttcgggcgcttttataacaaactataacagtcatgaacgtagtatacaaaaactaaacacaactttcaacaa

SEQ ID NO: 3065 - DNA, 151 bp, Cryptococcus rajasthanensis
  Tremellomycetes; Incertae sedis; Cryptococcus Cryptococcus rajasthanensis
gtaggtgaacctgcggaaggatcattaaagattggccgaaaggccttatccttatatccctcacctctgtgaactgtggaccctcgggtccgttttaacaaacatcagtgtaatgaacgtatcaatatataacaaaacaaaactttcaaca

SEQ ID NO: 3066 - DNA, 151 bp, Dioszegia sp.
  Tremellomycetes; Incertae sedis; Dioszegia Dioszegia sp TP_Snow_Y120
gtaggtgaacctgcggaaggatcattaataaatgagcgcaagcttttatattattccatacacctgtgaactattgccttcgggcatttatcaaacataatgtaatgaatgtaaactattataacaaaatataactttcaacaacggatct

SEQ ID NO: 3067 - DNA, 151 bp, Hannaella sp.
  Tremellomycetes; Incertae sedis; Hannaella
gtaggtgaacctgcggaaggatcattattaaatgttactccggtaactttataatcccttaacacctgtgcattttgtcgcttcggcgatattatacaaacatcagtgtaatgaatgtaaattattataacaaatacaactttcaacaacg

SEQ ID NO: 3068 - DNA, 151 bp, Unknown
  Description of Unknown: fungal polynucleotide
  Tremellomycetes
gtaggtgaacctgcggaaggatcactaaagtaaacgccctccggggctctctttaattcacacacccctgtgcactttggccacctgccgcgctttactgcgttagtaggtgtgtctttttaactatacactatatacacaagtcattgaa

SEQ ID NO: 3069 - DNA, 151 bp, Cryptococcus sp.
  Tremellomycetes; Incertae sedis; Cryptococcus Cryptococcus sp TP_Snow_Y44
gtaggtgaacctgcggaaggatcattaataatgccctctgacttcggtcagctgggttcaatgtgtgtcaactcttcggagttggccatccacacacaccgtgaactgtggcttcggccatcacaaactattagtaatgaatgtaaaatca

SEQ ID NO: 3070 - DNA, 151 bp, Unknown
  Description of Unknown: fungal polynucleotide
  Tremellomycetes; Incertae sedis
gtaggtgaacctgcggaaggatcattatcaaatgttacctctggtaactttataatcccttaacacctgtgcattttgtcgctccggcgatatcatacaaacatcagtgtaatgaatgtaaattatcataacaaatacaactttcaacaac

SEQ ID NO: 3071 - DNA, 151 bp, Unknown
  Description of Unknown: fungal polynucleotide
  Tremellomycetes; Incertae sedis
gtaggtgaacctgcggaaggatcattaatgattgaccctctgggtcttatcttaacatccctcacctctgtgaaccgtttgacctccgggtcttacaaaaaccataacaaacatcagtgtaaagaacgtcttgttatcttaacaaaaacaa

SEQ ID NO: 3072 - DNA, 151 bp, Cryptococcus albidus
  Tremellomycetes; Filobasidiaceae; Cryptococcus Cryptococcus albidus
gtaggtgaacctgcggaaggatcattaatgattaactgtctgtcgagcttgctcacagacttatcatatccataacacctgtgcacttgtcggatggcttagtgaagaccgcaaggttggaactatccatctactttacataacaatttag

SEQ ID NO: 3073 - DNA, 151 bp, Cryptococcus oeirensis
  Tremellomycetes; Filobasidiaceae; Cryptococcus Cryptococcus oeirensis
gtaggtgaccctgcggaaggatcattaatgaatcttacgccctagtcttaattgataggggctggttctatccataacacctgtgcactgttggatgcttgcatccacttttaaactaaacattattgtaacaaatgtagtcttattataa

SEQ ID NO: 3074 - DNA, 151 bp, Unknown
  Description of Unknown: fungal polynucleotide
  Tremellomycetes; Incertae sedis; unidentified Tremellales sp
gtaggtgaacctgcggaaggatcattaacaaagttcgcttctctgaagcaactgatctctaacacctgtgcatcttgtcgctccggcgatatatcaaacatcagtgtaaagaatgtaatttattataacaaatacaactttcaacaacgga

SEQ ID NO: 3075 - DNA, 151 bp, Hannaella luteola
  Tremellomycetes; Incertae sedis; Hannaella Hannaella luteola
gtaggtgaacctgcggaaggatcattattaaacgttacttcggtaacttaatatccttaacacctgtgcatcttgtcgctccggcgatattatacaaacatcagtgtaaagaatgtattatattataacaaatacaactttcaacaacgga

SEQ ID NO: 3076 - DNA, 151 bp, Unknown
  Description of Unknown: fungal polynucleotide
  Tremellomycetes; Incertae sedis
gtaggcgaacctgcggaaggatcattattaaatgttgcttcggtaactttataatcccttaacacctgtgcattttgtcgctccggcgatatcatacaaacatcagtgtaatgaatgtaaattattataacaaatacaactttcaacaacg

SEQ ID NO: 3077 - DNA, 151 bp, Unknown
  Description of Unknown: fungal polynucleotide
  Tremellomycetes; Incertae sedis
gtaggtgaacctgcggaaggatcattattaaatagttacttcggtaactttaatatccctaacacctgtgcattttgtcgctccggcgatatcatacaaacatcagtgtaatgaatgtaaattattataacaaatacaactttcaacaacg

SEQ ID NO: 3078 - DNA, 151 bp, Cryptococcus sp.
  Tremellomycetes; Incertae sedis; Cryptococcus Cryptococcus sp NYNU 1337
gtaggtgaacctgcggaaggatcattaaagattggccgagaggcctcatctctatatccctcaacctctgtgaaccgtggaccctcgggtctattttacaaacatcagtgtaatgaacgtaattatcataacaaaaacaaaactttcaaca

SEQ ID NO: 3079 - DNA, 151 bp, Cryptococcus sp.
  Tremellomycetes; Filobasidiaceae; Cryptococcus
gtaggtgaacctgcggaaggatcattaatgaataaaggtatcacgcctcacggctgtgtgttggatcattgtgcaatagtctttgatccacttcctatcatatccataacacctgtgcactgttggatgcttgcatccacttttaaactaa

SEQ ID NO: 3080 - DNA, 151 bp, Cryptococcus oeirensis
  Tremellomycetes; Filobasidiaceae; Cryptococcus Cryptococcus oeirensis
gtaggtgaacctgcggaaggatcattaatgaattttacgccctaggcttaagtgctaggggctggttctatccataacacctgtgcactgttggatgcttgcatccacttttaaactaaacattattgtaacaaatgtagtcttattataa

SEQ ID NO: 3081 - DNA, 151 bp, Bullera unica
  Tremellomycetes; Incertae sedis; Bullera Bullera unica
gtaggtgaacctgcggaaggatcattagtgattgacctccgggtcttaataactataatcttctacctctgtgaaccgttggtcttcggaccgattcttataacaaacatctgtgtaatgaacgtaacctatattaatcatataaaacttt

SEQ ID NO: 3082 - DNA, 151 bp, Dioszegia athyri
  Tremellomycetes; Incertae sedis; Dioszegia Dioszegia athyri
gtaggtgaacctgcggaaggatcattaataaacggcgaagctcgcaagagcctagctttatattattccataacacctgtgaactatttgccttcttgtcatgagaaggtacaaaccttacaaacttaactgtaatgaatgtaatctatta

SEQ ID NO: 3083 - DNA, 151 bp, Cryptococcus oeirensis
  Tremellomycetes; Filobasidiaceae; Cryptococcus Cryptococcus oeirensis
gtaggtgaacctgcggaaggatcattaatgaatataaatcgtactgttcacgcagtatgtggggtggtgacttcggtcccgctcattcatatccataacacctgtgcactgttggatgcttgcatccacttttaaactaaacattattgta

SEQ ID NO: 3084 - DNA, 151 bp, Bullera sp.
  Tremellomycetes; Incertae sedis; Bullera Bullera sp TY_176
gtaggtgaacctgcggaaggatcattaataaatgttacttcggtaacttaattaatccctaacacctgtgcatcttgtcgcttcggcgtcattttataaacatcagtgtaatgaatgtaaagtattataacaaatacaactttcaacaacg

SEQ ID NO: 3085 - DNA, 151 bp, Unknown
  Description of Unknown: fungal polynucleotide
  Tremellomycetes; unidentified; unidentified Tremellomycetes sp
gtaggtgaacctgcggaaggatcactaaagtaaacgccctccggggctctctttattcacacacccctgtgcactttggccacctgccgcgcttaactgcgttagtaggtgtgtctctttatttatacccatatacacaagtcattgaatg

SEQ ID NO: 3086 - DNA, 151 bp, Cryptococcus sp.
  Tremellomycetes; Incertae sedis; Cryptococcus Cryptococcus sp QMW_2009a
gtaggtgaacctgcggaaggatcattattgaattgtttgtttgaattggcttaaaaccccaattcggcatccatatccataacacctgtgcactgttggatgacctttgctctcacaagcgctggaagtccacttttacactaaacaattt

SEQ ID NO: 3087 - DNA, 151 bp, Cryptococcus laurentii
  Tremellomycetes; Incertae sedis; Cryptococcus Cryptococcus laurentii
gtaggtgaacctgcggaaggatcattattgattggtcgaaagaccttatcagattctaccacctctgtgaaccgttgacctccgggttaataatcaaacatcagtgtaacgaacgtaagagtatcttaattaaacaaaacttttaacaacg

SEQ ID NO: 3088 - DNA, 151 bp, Dioszegia athyri
  Tremellomycetes; Incertae sedis; Dioszegia Dioszegia athyri
gtaggtgaacctgcggaaggatcattaataaatggcgaagctcgaaagagtctaagctttatattattccataacacctgtgaactatttgccttcttgtcatgagaaggtacaacctatacaaacataactgtaatgaatgtaatctatt

SEQ ID NO: 3089 - DNA, 151 bp, Cryptococcus sp.
  Tremellomycetes; Incertae sedis; Cryptococcus Cryptococcus sp QMW_2009a
gtaggtgaacctgcggaaggatcattattgaattgtttgtttgaattggcttaaaaccccaattcagcaatacatatccataacacctgtgcactgttggatgagcaaactcgcaagagcaagcaagtccacttttacaccaaacaatttg

SEQ ID NO: 3090 - DNA, 151 bp, Cryptococcus sp.
  Tremellomycetes; Incertae sedis; Cryptococcus
gtaggtgaacctgcggaaggatcattagtgaacgccctcacgggcttaactatccaaccaatctctgtgaaccgtcgccctcgggcgctctattacaaactataacagtcatgaacgtagtatacaaaaatgaaacacaactttcaacaac

SEQ ID NO: 3091 - DNA, 151 bp, Udeniomyces puniceus
  Tremellomycetes; Cystofilobasidiaceae; Udeniomyces Udeniomyces puniceus
gtaggtgaacctgcggaaggatcactagtgattaaacgtgaagcgtcttacctgaccttctcacccttcacatccacatacaccctgtgagctgttcggcttcaactctcgaggtgggctctcctatcgatagattagcaatagtctagcg

SEQ ID NO: 3092 - DNA, 151 bp, Hannaella sp.
  Tremellomycetes; Incertae sedis; Hannaella
gtaggtgaacctgcggaaggatcattattaaatgttgctctgcaactttataatcccttaacacctgtgcattttgtcgctccggcgatatatacaaacatcagtgtaaagaatgtaaattattataacaaatacaactttcaacaacgga

SEQ ID NO: 3093 - DNA, 151 bp, Cryptococcus flavus
  Tremellomycetes; Filobasidiaceae; Cryptococcus Cryptococcus flavus
gtaggtgaacttgcggaaggatcattagtgaatgccctcacgggcttaactatccaaccaacctctgtgaactgtcgccctcgggcgcttctataacaagctataactgtcatgaacgtcgtacacaaaaacaaacacaactttcaacaac

SEQ ID NO: 3094 - DNA, 151 bp, Cryptococcus wieringae
  Tremellomycetes; Filobasidiaceae; Cryptococcus Cryptococcus wieringae
gtaggtgaacctgcggaaggatcattatagaaataagatgctagcttaacggccggcattttacccttcttatccataacacctgtgcactgttggatgcttgcatccacttttatactaaacaatttgtaacaaatgtagtcttattata

SEQ ID NO: 3095 - DNA, 151 bp, Cryptococcus sp.
  Tremellomycetes; Filobasidiaceae; Cryptococcus
gtaggtgaacctgcggaaggatcattaatgaataaaggaccaccgcctcacggcttggttgttggatcattgtgcaatagtctttgatccactttcctatcatatccataacacctgtgcactgttggatgcttgcatccacttttaaact

SEQ ID NO: 3096 - DNA, 151 bp, Cryptococcus oeirensis
  Tremellomycetes; Filobasidiaceae; Cryptococcus Cryptococcus oeirensis
gtaggtgaacctgcggaaggatcattaatgaattaaagccacacttcggtgtgcaagggtcatcagagttatgctcgttgacccaacttcatatccataacacctgtgcactgttggatgcttgcatccacttttaaactaaacattattg

SEQ ID NO: 3097 - DNA, 151 bp, Tremellales sp.
  Tremellomycetes; unidentified; unidentified Tremellales sp TG05
gtaggtgaacctgcggaaggatcattaataatgctctctggcttcggtcagttgagttcaatgagtgccttctcttcggagttggccatccacacacaccgtgaactgtggcttcggccatcacaaactgttagtaatgaatgtaatatca

SEQ ID NO: 3098 - DNA, 151 bp, Tremellales sp.
  Tremellomycetes; Incertae sedis; unidentified Tremellales sp
gtaggtgaacctgcggaaggatcattagaaatgtgccgcaaggccttatctaaccacacacaactgtgcacgccttcgggcataaactatttaacggtaatgaatgtaacaaagttaacacaatacaactttcaacaacggatctctaggc

SEQ ID NO: 3099 - DNA, 151 bp, Udeniomyces pannonicus
  Tremellomycetes; Cystofilobasidiaceae; Udeniomyces Udeniomyces pannonicus
gtaggtgaacctgcggaaggatcactagtgaatacatcggggagcgtcttaactgacctccccaacccttcacaatccacatacacctgtgcactgttttggcttttgagcaattgaaagccaatcattttatacaaacccctagtttaat

SEQ ID NO: 3100 - DNA, 151 bp, Cystofilobasidium infirmominiatum
  Tremellomycetes; Cystofilobasidiaceae; Cystofilobasidium Cystofilobasidium infirmominiatum
gtaggtgaacctgcggaaggatcactagagatttcgccctccggggctctctttttcttcacacacccctgtgcactttggctgccgcttcattgcggtggtcttttataattaccatacccatatacacaagtcattgaatgtaaaatcg

SEQ ID NO: 3101 - DNA, 151 bp, Cryptococcus sp.
  Tremellomycetes; Incertae sedis; Cryptococcus Cryptococcus aff taibaiensis IMUFRJ 51982
gtaggtgaacctgcggaaggatcattaatgatgccctcgacgtctttacgactggtagggtttgggtctggcctctggtcgaccttcatctaacacaccgtgaactgtggcctcggccattttacacaaactcttagtaatgaatgtatta

SEQ ID NO: 3102 - DNA, 151 bp, Cryptococcus sp.
  Tremellomycetes; Filobasidiaceae; Cryptococcus
gtaggtgaacctgcggaaggatcattaatgaataaagaaccacgcctcacggctgtgtctggatcattgtacattcgtcctttgatccagttctatcatatccataacacctgtgcactgttggatgcttgcatccacttttaaactaaac

SEQ ID NO: 3103 - DNA, 151 bp, Cryptococcus oeirensis
  Tremellomycetes; Filobasidiaceae; Cryptococcus Cryptococcus oeirensis
gtaggtgaacctgcggaaggatcattaatgaataagaacacgtctcatggcgttcttggatcattgtacattcgtctttgatccagttctctcatatccataacacctgtgcactgttggatgcttgcatccacttttaaactaaacatta

SEQ ID NO: 3104 - DNA, 151 bp, Cryptococcus laurentii
  Tremellomycetes; Incertae sedis; Cryptococcus Cryptococcus laurentii
gtaggtgaacctgcggaaggatcattaatgattggcctaacggccttatcaacataatccctcacctctgtgaaccgttgacctccgggtctacataacaaacatcagtgtaaagaacgtctttatattttaacaaaataaaactttcaac

SEQ ID NO: 3105 - DNA, 151 bp, Cryptococcus albidus
  Tremellomycetes; Filobasidiaceae; Cryptococcus Cryptococcus albidus
gtaggtgaacccgcggaagaatcattaatgattgaccgtctgtcgagcttgctcacaggcacatcatatccataacacctgtgcacttgtcggatggcttagtgaagaccgcaaggttgaatctatccatctactttacataacaattctg

SEQ ID NO: 3106 - DNA, 151 bp, Hannaella sp.
  Tremellomycetes; Incertae sedis; Hannaella Hannaella sp
gtaggtgaacctgcggaaggatcattattaaatgcgaagcctcacggcctagctttataatcccttattacacctgtgcaccttattgtcttcggacaatttactacaaacatcagtgtaacgaatgtaaagtattataatcaatacaact

SEQ ID NO: 3107 - DNA, 151 bp, Cryptococcus albidus
  Tremellomycetes; Filobasidiaceae; Cryptococcus Cryptococcus albidus
gtaggtgaacctgcggagggatcattaatgattgaccgtctgtcgagcttgctcacaggcacatcatatccataacacctgtgcacttgtcggatggcttagtgaagaccgcaaggttgaatctatccatctaccttacgtaacaattctg

SEQ ID NO: 3108 - DNA, 151 bp, Cryptococcus friedmannii
  Tremellomycetes; Filobasidiaceae; Cryptococcus Cryptococcus friedmannii
gtaggtgaacctgcggaaggatcattaatgaatgcagattcctgtcgagcttgctcacgggatttcatcatatccataacacctgtgcacttgttggatggtataacagagccctagtggtgaagttgtccatctaatttacactaaacaa

SEQ ID NO: 3109 - DNA, 151 bp, Cryptococcus sp.
  Tremellomycetes; Incertae sedis; Cryptococcus Cryptococcus sp TP_Snow_Y44
gtaggtgaacctgcggaaggatcattaataatgccctctggcttcggtcagctgggttcaatgtgtgtcatctcttcggagatggccatccacacacaccgtgaactgtgacttcggtcatcacaaacttttagtaatgaatgtaaaaatc

SEQ ID NO: 3110 - DNA, 151 bp, Wallemia sebi
  Wallemiomycetes; Wallemiaceae; Wallemia Wallemia sebi
gtaggtgaacctgcggaaggatcattagtgattaattattgagtgtaaaaaactcataatcttctatacaaaccactgttttaaaatgtttactagaatgtccaagcagttaagctgttgaaatattaaaagtttaataaaactttcagca

SEQ ID NO: 3111 - DNA, 151 bp, Wallemia muriae
  Wallemiomycetes; Wallemiaceae; Wallemia Wallemia muriae
gtaggtgaacctgcggaaggatcattagtgattaattattgagtgataaaaaactcataatcttctacaaaccactgttttaaaatgtttactagaatgtccaagcagttaagctgttgaaatattaaaagttttataaaactttcagcaa

SEQ ID NO: 3112 - DNA, 151 bp, Wallemia sebi
  Wallemiomycetes; Wallemiaceae; Wallemia Wallemia sebi
gtaggtgaacctgcggaaggatcattagtgattaattattgagtgtaaaaactcataatcttctattacaaaccactgttttaaaatgtctactagaatgtccaagcagttaagctgttgaaattataaaagtttaataaaactttcagca

SEQ ID NO: 3113 - DNA, 1377 bp, Burkholderia caledonica
tagcaatcctggtggcgagtggcgaacgggtgagtaatacatcggaacgtgtcctgtagtgggggatagcccggcgaaagccggattaataccgcatacgatctgtggatgaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatcccagcaatgccgcgtgtgtgaagaaggccttcgggttgtaaagcacttttgtccggaaagaaaacctcgtggttaatacccgtgggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaacctggctgagaggtccgggtgcccgaaagggagccataacacagggtgctgcatggctgtcgtcagctcgtgtcgtgagatgttgggataagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacg

SEQ ID NO: 3114 - DNA, 1359 bp, Ochrobactrum sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccact

SEQ ID NO: 3115 - DNA, 1421 bp, Enterobacter sp.
ctacacatgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttgcagagatgcattggtgccttcgggaactgtgagacaggtgctgcatggctgtcgtcagctcgtgttgtgaaatgttgggttaagtcccgcaacgagcgcaacccttatcctttgttgccagcggtcaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccactt

SEQ ID NO: 3116 - DNA, 1418 bp, Pantoea sp.
catgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacgggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttcacaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacct

SEQ ID NO: 3117 - DNA, 1424 bp, Enterobacter sp.
tacacatgcagtcgaacggtagcacagagagcttgctctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtggagttaataccttcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttga

SEQ ID NO: 3118 - DNA, 1409 bp, Bacillus sp.
cagtcgagcgatggattgagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccgggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggag

SEQ ID NO: 3119 - DNA, 1362 bp, Agrobacterium sp.
accatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagcagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggataagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacgt

SEQ ID NO: 3120 - DNA, 1422 bp, Bacillus sp.
atgcagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaacccagaaagccacgggctaactacgtgccagcagccgcggtaatacgtaggtggcaagcgttgtccggaattattgggcgtaaagcgcgcgcaggcggtcctttaagtctgatgtgaaagcccacggctcaacccgtggagggtcattggaaactgggggacttgagtgcagaagagaagagtggaatttccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgtgggtaacccttctgggagccagcct

SEQ ID NO: 3121 - DNA, 785 bp, Microbacterium binotii
tgcagtcgaacggtgaagcagagcttgctctgtggatcagtggcgaacgggtgagtaacacgtgagcaacctgccctggactctgggataagcgctggaaacggcgtctaatactggatacgagacgtggccgcatggtcaacgtttggaaagattttttggttcaggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagc

SEQ ID NO: 3122 - DNA, 1384 bp, Chryseobacterium sp.
agccgagcggtatttcttcttcggaagagagagagcggcgtacgggtgcggaacacgtgtgcaacctacctttatcagggggatagcctttcgaaaggaagattaataccccataatatattgaatggcatcatttaatattgaaaactccggtggatagagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggtgaaagcctgatccagccatcccgcgtgaaggacgacggccctatgggttgtaaacttcttttgtacagggataaacctttccacgtgtggaaagctgaaggtactgtacgaataagcaccggctaactccgtgccagcagccgcggtaatacggagggtgcaagcgttatccggatttattgggtttaaagggtccgtaggcggacctgtaagtcagtggtgaaatctcatagcttaactatgaaactgccattgatactgcaggtcttgagtaaatttgaagtggctggaataagtagtgtagcggtgaaatgcatagatattacttagaacaccaattgcgaaggcaggtcactaagatttaactgacgctgagggacgaaagcgtggggagcgaacaggattagataccctggtagtccacgccgtaaacgatgctaactcgtttttggattttcggattcagagaccaagcgaaagtgataagttagccacctggggagtacgtccgcaaggatgaaactcaaaggaattgacgggggcccgcacaagcggtggattatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctaacattcagttgaggactctagtgagactgcctacgcaagtagagaggaaggtggggatgacgtcaaatcatcacggcccttacgtcttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtttggggtacctgaagtcggtgaccgtaaaaggagctgccta

SEQ ID NO: 3123 - DNA, 1415 bp, Pseudomonas sp.
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagactaagcaccggctaacttcgtgccagcagccgcggtaatacgaagggtgcaagcgttaatcggaattactgggcgtaaagcgcgcgtaggtggcttgataagttgggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgccttgatgcttacctggccttgacatgctgagaacctttcagagatggatacgtgccttcgggaactctcagactcgtgctgcatggctgtcgtcagctcgtgtcgtgagatgttgggttaagtcccgatacgagcgcaacggtactggtaagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacga

SEQ ID NO: 3124 - DNA, 1432 bp, Staphylococcus sp.
tatacatgcagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattggggcgtaaagcgcgcgtaggcggtttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcggaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcga

SEQ ID NO: 3125 - DNA, 1398 bp, Micrococcus sp.
accatgcagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattccctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagtagcttaccaaggcttgacatgttctcgatcgccgtagagatacggttttccctttggggcgggatcacaggatggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcg

SEQ ID NO: 3126 - DNA, 1430 bp, Paenibacillus sp.
agtcgagcggagtcttggttggaagcttgcttccaacttggcttagcggcggacgggtgagtaacacgtaggcaacctgcccctaagactgggataactaccggaaacggtagctaataccggataatctctttcctctcctgagggaagaatgaaaggcggagcaatctgccacttggggatgggcctgcggcgcattagctagttggcggggtaacggcccaccaaggcgacgatgcgtagccgacctgagagggtgaacggccacactgggactgagacacggcccagactcctacgggaggcagcagtagggaatcttccgcaatgggcgacagcctgacggagcaacgccgcgtgagtgatgaaggttttcggatcgtaaagctctgttgccagggaagaacgtccggtagagtaactgttaccggagtgacggtacctgagaagaaagccccggctaactacgtgccagcagccgcggtaatacgtagggggcaagcgttgtccgggaattattgggcgtaaagcgcgcgcaggcggctatttaagtctggtgtttaaaccttgggctcaacctggggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaacctttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggttgagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagcctccg

SEQ ID NO: 3127 - DNA, 1413 bp, Pseudomonas sp.
acacatgcagtcgagcggatgatgggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtaccacg

SEQ ID NO: 3128 - DNA, 1400 bp, Herbaspirillum sp.
agacagtcgaacggcagcataggagcttgctcctgatggcgagtggcgaacgggtgagtaatatatcggaacgtgccctagagtgggggataactagtcgaaagactagctaataccgcatacgatctacggatgaaagtgggggatcgcaagacctcatgctcctggagcggccgatatctgattagctagttggtggggtaaaagcctaccaaggcaacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtagtagctaatatctattactaatgacggtacctgaagaataagcaccggctaactacgtgccagcagccgcggtaatacgtagggtgcaagcgttaatcggaattactgggcgtaaagcgtgcgcaggcggttgtgtaagtcagatgtgaaatccccgggctcaaccctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcccgaagagatttgggagtgctcgaaagagaaccatcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgta

SEQ ID NO: 3129 - DNA, 1408 bp, Achromobacter sp.
cacatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 3130 - DNA, 1412 bp, Paenibacillus sp.
gcaagagaagcttgcttctctgatgcgttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccgggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacgcgcacaagcagtggagtatgtggtttaattcgaagcaacgcgaagaaccttaccagggtcttgacatccaactaacgaggcagagatgcatcaggtgcccttcggggaaagttgagacaggtggtgcatggttgtcgtcagctcgtgtcgtgagatgttgggttaagtcccgcaacgagcgcaacccttatatttagttgccagcatttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagcctccg

SEQ ID NO: 3131 - DNA, 1422 bp, Xanthomonas sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgctactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaacattgcagagatggattggtgccttcgggaaccgtgagacaggtgctgcatggctgtcgtcagctcgtgtcctgtcatgttcggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 3132 - DNA, 1304 bp, Unknown
  Description of Unknown: bacterium polynucleotide
  Methylobacteriaceae
catgcaagtcgagcgggcatccttgtggtgtcagcggcagacgggtgagtaacgcgtgggaacgtgcccttcggttcggaataactcagggaaacttgagctaataccggatacgtgcgagagcagaaaggtttactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaatttgaagcaacgcgcagaaccttaccatcccttgacatggcatgcgagctggagagatcggctgttcccttcggggacgtgcacacaggtgctgcatggctgtcgtcagctcgtgtcgtgagatgttgggttaagtcccgcaacgagcgcaacccacgtcttcagttgccatcatttggttgggcactctggggagactgccggtgataagccgcgaggaaggtgtggatgacgtcaagtcttcatggcccttacgggatgggctacacacgtgctacaatggcggtgacaatgggcagcgaaggggcgacctggagagaatccccaaaagccgtctcagttcggattgcactctgcaactcgggtgcacgaaggcggaatcgctagtaatcgtggatcagcatgccacggtgaatacgttcccgggccttgtacacaccgcccgtcacacca

SEQ ID NO: 3133 - DNA, 1419 bp, Enterobacter sp.
cacatgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctggtcttgacatccacagaacttggcagagatgccttggtgccttcgggaactgtgagaacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccacat

SEQ ID NO: 3134 - DNA, 1432 bp, Bacillus sp.
atacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgaccggtacctaaccagaaaaggccacggctaactacgtgccagcagccgcggtaatacgtaggtggcaagcgttgtccggaattattgggcgtaaagggctcgcaggcggtttcttaagtctgatgtgaaagcccccggctcaacccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggattaattcgaagcaacgcgaagaagcttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggt

SEQ ID NO: 3135 - DNA, 1418 bp, Unknown
  Description of Unknown: bacterium polynucleotide
  Enterobacteriaceae
cacatgcagtcgaacggtagcacagaggagcttgctcctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctggttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattaggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccatag

SEQ ID NO: 3136 - DNA, 1421 bp, Enterobacter sp.
acatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcacgtgcgaaagcgtggggagcaaacaggattagataccctggtagtccacgccgtatacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagaaccttacctactcttgacatccagagaactttgcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 3137 - DNA, 1417 bp, Staphylococcus sp.
cagtcgagcgacagacgaggagcttgctcctctgacgttagcggcggacgggttagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattcccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccgtgtggagtaacctttggagctagcctac

SEQ ID NO: 3138 - DNA, 1399 bp, Burkholderia sp.
caagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 3139 - DNA, 1415 bp, Unknown
  Description of Unknown: bacterium polynucleotide
  Enterobacteriaceae
catgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacccat

SEQ ID NO: 3140 - DNA, 1412 bp, Pseudomonas sp.
catgcagtcgagcggatgagaggagcttgctcctcgattcagcggcggacgggtgagtaatgcctaggaatctgcccagtagtgggggacaacgtttcgaaaggaacgctaataccgcatacgtcctacgggagaaagtgggggatcttcggacctcacgctattggatgagcctaggtcggattagctagttggtggggtaacggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggcttacagcgaaatacctgtgagttttgacgttaccaacagaataaagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggattaattcgaagcaacgcgaagaaaccttacctggccatgacttgctgagaactttccagaacatggattggtgccttcgggtactcagacacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcggggggacggtacca

SEQ ID NO: 3141 - DNA, 1416 bp, Pantoea sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctggccttgacatccagagaacttagcagagatgctttggtgccttcgggaacttctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttac

SEQ ID NO: 3142 - DNA, 1423 bp, Stenotrophomonas sp.
cacatgcaagtcgaacggcagcacagaggagcttgctccttgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctaccctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaagcttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 3143 - DNA, 1362 bp, Sphingomonas sp.
cacatgcagtcgaacgagatcttcgggtctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccat

SEQ ID NO: 3144 - DNA, 1417 bp, Pseudomonas sp.
atgcaagtcgagcggatgaggggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctgggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacggagtat

SEQ ID NO: 3145 - DNA, 1419 bp, Erwinia sp.
acatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgcccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctgggccttgacatccagagaacttagcagagatgctttggacgcttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatag

SEQ ID NO: 3146 - DNA, 1401 bp, Burkholderia sp.
ccatgcagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggt

SEQ ID NO: 3147 - DNA, 1396 bp, Burkholderia sp.
gaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaaccctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 3148 - DNA, 1386 bp, Burkholderia sp.
agcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctg

SEQ ID NO: 3149 - DNA, 1401 bp, Burkholderia sp.
cagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctaccccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 3150 - DNA, 1403 bp, Burkholderia sp.
atgcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 3151 - DNA, 1418 bp, Xanthomonas sp.
ccatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccac

SEQ ID NO: 3152 - DNA, 1360 bp, Sphingomonas sp.
atagcagtcgaacgatgctttcgggcatagtggcgcacgggtgcgtaacgcgtgggaatctgcccttgggtctgggataacagttggaaacgactgctaataccggatgatatcgcgagatcaaagatttatcgcccgaggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactgggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaacctcgcaagaggaggcaggcgac

SEQ ID NO: 3153 - DNA, 1422 bp, Enterobacter sp.
taccatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtaccgccgcaaggttaaaactcaaatgaattgacgggggcccgcacaagcggtggagcatgtggtttaattcgatgcaacgcgaagtaccttacctactcttgacatccagagtacttttcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 3154 - DNA, 1420 bp, Pantoea sp.
accatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggcccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactt

SEQ ID NO: 3155 - DNA, 1416 bp, Pseudomonas sp.
acatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatcccccgggctcaacctgggaactgcatccaaaactgtctggctagagtgtggtagagggtagtggaatttcccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggtttagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgga

SEQ ID NO: 3156 - DNA, 1403 bp, Pseudomonas sp.
atgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcacagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaaccctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacgg

SEQ ID NO: 3157 - DNA, 1417 bp, Pantoea sp.
catgcagtcgacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaatttccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtgggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 3158 - DNA, 1400 bp, Burkholderia sp.
aagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 3159 - DNA, 1416 bp, Enterobacter sp.
cacatgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 3160 - DNA, 1418 bp, Pseudomonas sp.
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagatgcttacctggccttgacatgctgagaacattgcagagatggatatgtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacggagta

SEQ ID NO: 3161 - DNA, 1417 bp, Erwinia sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgctacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccac

SEQ ID NO: 3162 - DNA, 1409 bp, Erwinia sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtcatgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggc

SEQ ID NO: 3163 - DNA, 1375 bp, Microbacterium sp.
acgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtagacgttgggaaactagttgtggggaccattccacggtttccgtgacgcagctaacgcattaagttccccgcctgggggagtacggccgcaaggctaaaactcaaaaggcaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtgga

SEQ ID NO: 3164 - DNA, 1422 bp, Xanthomonas sp.
acatgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 3165 - DNA, 1407 bp, Pseudomonas sp.
catgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgttctagcttacctggccttgacatgctgagaacattgcagagatgctatgctgccttccgggactcagacacaggtgctgcatggctgtcgtcagctcgtgtcctgagatgatcggttaagtcccgtaacgagcgcaacccttgtccttagtatccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtacc

SEQ ID NO: 3166 - DNA, 1414 bp, Pantoea sp.
ctaccatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctca

SEQ ID NO: 3167 - DNA, 1403 bp, Pantoea sp.
cagtcgacggcagcacagaatgagcttgctctttgggtggcgagtggcggacgggtgagtaatagtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagttagcttaacctcgggagggct

SEQ ID NO: 3168 - DNA, 1361 bp, Ochrobactrum sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactatagt

SEQ ID NO: 3169 - DNA, 1392 bp, Microbacterium sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaagcttaccaaggcttgacatatacgagaacgggccagaaatggtcaactctttggacactcgtaaacaggacgtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccg

SEQ ID NO: 3170 - DNA, 1390 bp, Microbacterium sp.
cagcagtcgaacggtggagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccta

SEQ ID NO: 3171 - DNA, 1420 bp, Erwinia sp.
acatgcagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaacctttacctactcttgacatccagcgaacggggcagagatgccgccgagtgtgcttcgggtacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccata

SEQ ID NO: 3172 - DNA, 1420 bp, Pantoea sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagtacttagcagagatgctttggtgccttcgggaactctgagacaggtgctgcatggctgtcgtcagctcgtgttgacaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttg

SEQ ID NO: 3173 - DNA, 1409 bp, Pantoea sp.
cgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccact

SEQ ID NO: 3174 - DNA, 1413 bp, Erwinia sp.
agtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaaggcggccccctgggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatag

SEQ ID NO: 3175 - DNA, 1355 bp, Ochrobactrum sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtccact

SEQ ID NO: 3176 - DNA, 1425 bp, Stenotrophomonas sp.
accatgcaagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagcccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 3177 - DNA, 1390 bp, Achromobacter sp.
agtcgacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcg

SEQ ID NO: 3178 - DNA, 1393 bp, Microbacterium sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtaccctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaatagctcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccg

SEQ ID NO: 3179 - DNA, 1429 bp, Bacillus sp.
tacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtgggagcatgtgggtttaattcgaagcaacgcgaagaaccttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatgg

SEQ ID NO: 3180 - DNA, 1367 bp, Sphingomonas sp.
acatgcagtcgaacgaaggcttcggccttagtggcgcacgggtgcgtaacgcgtgggaatctgcccttaggttcggaataacagctggaaacggctgctaataccggatgatatcgcgagatcaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgcaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgccctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggattttcttcccttcggggactgggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggt

SEQ ID NO: 3181 - DNA, 1421 bp, Pantoea sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacttctccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgatgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgat

SEQ ID NO: 3182 - DNA, 1420 bp, Pantoea sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagtagcttacctggccttgacatccagagaacttagcagagatgctttggtcgcttcgggaactctgacacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttt

SEQ ID NO: 3183 - DNA, 1420 bp, Pantoea sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagacaacttagcacagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttg

SEQ ID NO: 3184 - DNA, 1417 bp, Pantoea sp.
cacatgcagtcgagcggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccac

SEQ ID NO: 3185 - DNA, 1419 bp, Erwinia sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctgggccttgacatccagagaacttagcagagatgctttggtgccttcggggactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccattt

SEQ ID NO: 3186 - DNA, 1410 bp, Erwinia sp.
tcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccagagaacttagcagagatgctttgggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccata

SEQ ID NO: 3187 - DNA, 1361 bp, Ochrobactrum sp.
catgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgtag

SEQ ID NO: 3188 - DNA, 1357 bp, Ochrobactrum sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacta

SEQ ID NO: 3189 - DNA, 1402 bp, Achromobacter sp.
catgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 3190 - DNA, 1407 bp, Achromobacter sp.
accatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccatag

SEQ ID NO: 3191 - DNA, 1403 bp, Achromobacter sp.
catgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcctgaagagatttgggaagtgctcgcaagagaatcgggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatac

SEQ ID NO: 3192 - DNA, 1405 bp, Achromobacter sp.
ccatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccat

SEQ ID NO: 3193 - DNA, 1399 bp, Microbacterium sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacagggtggtgcatgggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 3194 - DNA, 1422 bp, Bacillus sp.
catgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctccg

SEQ ID NO: 3195 - DNA, 1414 bp, Luteibacter sp.
tgcagtcgaacggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggcttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgacc

SEQ ID NO: 3196 - DNA, 1399 bp, Curtobacterium sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacagccagagatggttgcccccttgtggtcggtgtacacgtggtgcatgggttgtcgtcagctcgtgtcgtgacttgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaatgg

SEQ ID NO: 3197 - DNA, 1385 bp, Curtobacterium sp.
cagtcgacgatgatgcccagcttgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaacgcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagcct

SEQ ID NO: 3198 - DNA, 1438 bp, Paenibacillus sp.
actaatacatgcaagtcgagcggacttgatgagaagcttgcttctctgatgcgttagcggcggacgggtgagtaacacgtaggcaacctgccctcaagtttgggacaactaccggaaacggtagctaataccgaatagttgtttccttcgcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctccaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccgaatgaccggtgcagagatgtaccttttcttcggaacattcaagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 3199 - DNA, 1424 bp, Pantoea sp.
gctacacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaacttgccgattgacgttacccgcagaagaagcaccggctaactccgtgccagcagccgcattaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaatagtagggttaagtcccggtacgagcgcaagccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgg

SEQ ID NO: 3200 - DNA, 1419 bp, Erwinia sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctactcata

SEQ ID NO: 3201 - DNA, 1365 bp, Ochrobactrum sp.
acatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagaatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactataat

SEQ ID NO: 3202 - DNA, 1362 bp, Ochrobactrum sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacggcggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgta

SEQ ID NO: 3203 - DNA, 1355 bp, Ochrobactrum sp.
catagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcc

SEQ ID NO: 3204 - DNA, 1353 bp, Ochrobactrum sp.
tgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 3205 - DNA, 1423 bp, Stenotrophomonas sp.
ccatgcagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcgggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgga

SEQ ID NO: 3206 - DNA, 1404 bp, Achromobacter sp.
ccatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcggatctctttaggaagtgctcgcaagagaacccgtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccag

SEQ ID NO: 3207 - DNA, 1401 bp, Achromobacter sp.
gcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 3208 - DNA, 1389 bp, Achromobacter sp.
acggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtatggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaagcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgagacc

SEQ ID NO: 3209 - DNA, 1415 bp, Enterobacter sp.
catgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagtacttggcagacatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccata

SEQ ID NO: 3210 - DNA, 1419 bp, Enterobacter sp.
tgacagtcgacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagaaacgttacctggtcttgacatccacagaactttggcagagatgccttggtgccttccggaactgtgacacacgtgctgcatggctgtcgtcagcctcgagttgagaaatggttagggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccatc

SEQ ID NO: 3211 - DNA, 1402 bp, Microbacterium sp.
catgcaagtcgaacgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactgggtgaacaggtggtgcatggttgtcgtcagctcgtggtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtg

SEQ ID NO: 3212 - DNA, 1394 bp, Microbacterium sp.
atgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 3213 - DNA, 1392 bp, Microbacterium sp.
acttgcagtcgaacggtgaagccaagcttgcttggtggatcagtggcgaacgggtgagtaacacgtgagcaacctgccctggactctgggataagcgctggaaacggcgtctaatactggatatgagccttcatcgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccta

SEQ ID NO: 3214 - DNA, 1396 bp, Microbacterium sp.
gcaagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtaccctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaa

SEQ ID NO: 3215 - DNA, 1422 bp, Bacillus sp.
aatacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggatttgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctc

SEQ ID NO: 3216 - DNA, 1393 bp, Paenibacillus sp.
acttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggcagcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaac

SEQ ID NO: 3217 - DNA, 1398 bp, Microbacterium sp.
gcacatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaaagcgccggctaactacgtgccagcagccgcggtaatacgtagggcgcaagcgttatccgggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacgggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtc

SEQ ID NO: 3218 - DNA, 1391 bp, Curtobacterium sp.
acatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccgggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 3219 - DNA, 1369 bp, Curtobacterium sp.
tcgacgatgatgcccagcttgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctg

SEQ ID NO: 3220 - DNA, 1409 bp, Pantoea sp.
acagcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggccccgcacaagccgtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcta

SEQ ID NO: 3221 - DNA, 1413 bp, Pantoea sp.
tcgacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaaggtactttcagccgggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagaagaacttagcacagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 3222 - DNA, 1388 bp, Erwinia sp.
gcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagctt

SEQ ID NO: 3223 - DNA, 1360 bp, Ochrobactrum sp.
catagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaacccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagaatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccac

SEQ ID NO: 3224 - DNA, 1352 bp, Ochrobactrum sp.
tagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagcccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaacctgcaaggaggcaggcg

SEQ ID NO: 3225 - DNA, 1419 bp, Bacillus sp.
atgcagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaagcttaccatggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccg

SEQ ID NO: 3226 - DNA, 1411 bp, Achromobacter sp.
tacacatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagatccggaacacaggtgctgcatggctgtcgtcagctcgtgtcgtgagatgttgggataagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactagt

SEQ ID NO: 3227 - DNA, 1398 bp, Microbacterium sp.
cacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaagcttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcga

SEQ ID NO: 3228 - DNA, 1418 bp, Bacillus sp.
catgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaacgctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgc

SEQ ID NO: 3229 - DNA, 1350 bp, Paenibacillus sp.
gtaggcaacctgccctcaagcttgggacaactaccggaaacggtagctaataccgaatacttgttttcttcgcctgaagggaactggaaagacggagcaatctgtcacttgaggatgggcctgcggcgcattagctagttggggaggtaacggctcaccaaggcgacgatgcgtagccgacctgagagggtgatcggccacactgggactgaaacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagcca

SEQ ID NO: 3230 - DNA, 1421 bp, Bacillus sp.
gcaagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcctat

SEQ ID NO: 3231 - DNA, 1402 bp, Luteibacter sp.
acggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacggcggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgtcg

SEQ ID NO: 3232 - DNA, 1388 bp, Pseudomonas sp.
gtagcagtcgtgcgggtgtaagacgcgatgattgctcctcgattcagcggcggacgggtgagtaatggctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtgggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagtag

SEQ ID NO: 3233 - DNA, 1393 bp, Curtobacterium sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgccaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 3234 - DNA, 1395 bp, Curtobacterium sp.
ccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcga

SEQ ID NO: 3235 - DNA, 1419 bp, Pantoea sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagatgcttacctggccttgacatccagagaacatagcagagatgctttggtgccttgcggtactctgagacaggtgctgcatggctgtcgtcagctcgtgttgactaatgttgggttaagtcccgcatgctgcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactta

SEQ ID NO: 3236 - DNA, 1409 bp, Pantoea sp.
agtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatc

SEQ ID NO: 3237 - DNA, 1411 bp, Achromobacter sp.
catgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactagtag

SEQ ID NO: 3238 - DNA, 1391 bp, Microbacterium sp.
acatgcagtcgaacggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccg

SEQ ID NO: 3239 - DNA, 1401 bp, Microbacterium sp.
ccatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctggggccgtaactgacgctgaggagcgaaaggggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaat

SEQ ID NO: 3240 - DNA, 1426 bp, Bacillus sp.
tacatgcaagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatg

SEQ ID NO: 3241 - DNA, 1429 bp, Bacillus sp.
actacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccagggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatg

SEQ ID NO: 3242 - DNA, 1401 bp, Paenibacillus sp.
gaagcttgcttccttgatacttagcaggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagcctc

SEQ ID NO: 3243 - DNA, 1379 bp, Micrococcus sp.
tgcaagtcgaacgatgaagcccagcttgctgggtggattagtggcgaacgggtgagtaacacgtgagtaacctgcccttaactctgggataagcctgggaaactgggtctaataccggataggagcgcccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacggggggcccgcacaagcggcggagcatgcggattaatttgatgcaacgcgaagaaccttaccaaggcttgacatgttcctcgatcgctgtacagatacggtttcccctttgggacgggttcacaggtggtgcatggttgtagtcagctcgtgtcgtgagatgtagggttaagtcccgcaacgagcgcaaccctcgttccatgttgccagcacgtcgtggtggggaatcatgggaggctgccggggtcaactaggaggaaggtgaggacgacgtcaaatcatcatgccccttatgtcttgggcttcacgcatgctacaatggccggtacaatgggttgcgatactgtgaggtggagctaatcccaaaaagccggtctcagttcggatgggggtgtgcaactcgaccccatgaagtcggagtcgctagtaatcgcagatcagcaacgatgcggtgaatacgttcccgggccttgtacaccccgcccgtcaagtcacgaaagttggtaacacccgaagccggtggcctaaccctt

SEQ ID NO: 3244 - DNA, 1396 bp, Micrococcus sp.
ttgcagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaacccccggatctgcggtgggtacgggcagactagagtgcagtaggggagactggaattccctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacgggtttcccgtttggggcgggttcacaggacgatgtacgatgtcgtcagctcgtgtcgtgagatgttgggataagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttctggtaacacccgaagccggtggcctaacccttgtggggggagccgt

SEQ ID NO: 3245 - DNA, 1415 bp, Pseudomonas sp.
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacggggggcccgcacaagcggtggagcatggtggtttaattcgaagcaacgcgaagtaccttacctggccttgacatgctgagaaccttgcagagatggattggtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacg

SEQ ID NO: 3246 - DNA, 1401 bp, Curtobacterium sp.
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagcttacgcattaagcgccccgcctggggagtacggccgcaaggctaaaactcaaaggaattgacgggggcccgcacaagcggcggagcatgcggattaattcgatgcaacgcgaagaagcttaccaaggcttgacatacaccggaaacggccagagatggttggccccttgtggtcggtgtacaggtggtgcatggatgtcgtcagctcgtgtcgtgacatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaagt

SEQ ID NO: 3247 - DNA, 1410 bp, Curtobacterium sp.
accatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaaaccctcttttagtagggaagaagcgtaagtgacggtacctgcagaaaaaagcaccgggctaactacgtgccagcagccgcggtaatacgtagggtgcaagcgttgtccgggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacagccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgattc

SEQ ID NO: 3248 - DNA, 1410 bp, Pantoea sp.
gacagtcgaacggcagcacagaagaagcttgctctattgggtggcgagtggcggacggtggagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcataaagaagtagttagcttaaccttcgggagggctc

SEQ ID NO: 3249 - DNA, 1391 bp, Microbacterium sp.
agcagtcgacggtgaaagagagcttgctctctggatcagtggcgaacgggtgagtaacacgtgagcaatctgcccctgactctgggataagcgctggaaacggcgtctaataccggatacgagctgcgaaggcatcttcagcagctggaaagaacttcggtcagggatgagctcgcggcctatcagctagttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgcaaaggcagatctctgggccgtaactgacgctgaggagcgaaagggtggggagcaaatcaggctttagataccctggtagtccaccccgtaaacgttgggaactagttgtggcgtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccatggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagcct

SEQ ID NO: 3250 - DNA, 1333 bp, Sphingomonas sp.
gagagccttcggagtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgctttgggtggcgcagctaacgcacttaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgctgacgcagatc

SEQ ID NO: 3251 - DNA, 1418 bp, Paenibacillus sp.
agcagtcgagcggagttgatgggaaagcttgcttccctgagacttagcggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccagggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaactgcaaggagcc

SEQ ID NO: 3252 - DNA, 1393 bp, Paenibacillus sp.
cttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgcagtatgtggtttaattcgaagcaacgcgaagaaccttaccaggtcttgacatccaactaacgaggcagagatgcatcaggtgcccttcggggaaagttgagacaggtggtgcatggttgtcgtcagctcgtgtcgtgagatgttgggttaagtcccgcaacgagcgcaacccttatatttagttgccagcacttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaact

SEQ ID NO: 3253 - DNA, 1426 bp, Pantoea sp.
accatgcagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagacggcctttcgcgggttgtaaagtactttccaagcggggaggaaggcgatgaggttaataaccttgttgattgacgttacccgcaggaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcacgtgcgaaagcgtggggagcaaacacgattacataccctggtagtccacgccgtaaacgatgtcgacttggaggttgttcccttgaggagtggcttcccgagctaacgcgttaagtcgaccgcctggcgagtacggccgcaaggttaaaactcaaatgaattgacgggggcccgcacaagcggtggagcatgtggtttaattccatgcatcgcgaagaaccttacctactcttgacatccaccgaacttagggcagagatgccttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccact

SEQ ID NO: 3254 - DNA, 1419 bp, Pantoea ananatis
ccatgcagtcggacggtagcacagaggagcttgctcctcgggtgacgagtggcggacgggtgagtaatgtctggggatctgcccgatagagggggataaccactggaaacggtggctaataccgcaaaacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaatttccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggattaaactcaaatgaattgacgggggcccgcacaagcggtggagcatgtggtttaattcgatgcaacgcgaagaaccatacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggctagcttaaccttcgggagggcgctaccactt

SEQ ID NO: 3255 - DNA, 1415 bp, Unknown
  Description of Unknown: bacterium polynucleotide
  Enterobacteriaceae
gcagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtgggtttaattcgatgcaacgcgaagaaccttacctactcttgacatccagcgaactttccagagatgggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccatag

SEQ ID NO: 3256 - DNA, 1398 bp, Unknown
  Description of Unknown: bacterium polynucleotide
  Enterobacteriaceae
caacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccata

SEQ ID NO: 3257 - DNA, 1415 bp, Pantoea sp.
atgcagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccatag

SEQ ID NO: 3258 - DNA, 1363 bp, Unknown
  Description of Unknown: bacterium polynucleotide
  Enterobacteriaceae
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtat

SEQ ID NO: 3259 - DNA, 1411 bp, Unknown
  Description of Unknown: bacterium polynucleotide
  Enterobacteriaceae
cacatgcagtcggacggtagcacagagagagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgc

SEQ ID NO: 3260 - DNA, 1362 bp, Unknown
  Description of Unknown: bacterium polynucleotide
  Enterobacteriaceae
aagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtat

SEQ ID NO: 3261 - DNA, 1360 bp, Pantoea sp.
agcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcagcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagta

SEQ ID NO: 3262 - DNA, 1415 bp, Unknown
  Description of Unknown: bacterium polynucleotide
  Enterobacteriaceae
ccatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacacacatgggagtgggttgcaaaagaagtaggtagcttaaccttcgggagggcgcttac

SEQ ID NO: 3263 - DNA, 1411 bp, Unknown
  Description of Unknown: bacterium polynucleotide
  Enterobacteriaceae
caagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctactcttgacatccacggaattcgggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacacgcatgggagtgggttgcaaaagaagtaggtagcttaacctccgggagggcgcttac

SEQ ID NO: 3264 - DNA, 1405 bp, Unknown
  Description of Unknown: bacterium polynucleotide
  Enterobacteriaceae
atgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaagctttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagg

SEQ ID NO: 3265 - DNA, 1422 bp, Pseudomonas sp.
acacatgcagtcgagcggtagagaggtgcttgcacctcttgagagcggcggacgggtgagtaaagcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgttgtagcggtgaaatgcgtgatacagatataggaaggaacaccagtggcgaaggcgacccacctggactgatactgacactgaggtgcgaaagcgtggggagcaaacaggattagataccctgggtagtccacgcccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagtaccttaccaggccttgacatcctatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggtaccacg

SEQ ID NO: 3266 - DNA, 1405 bp, Pseudomonas sp.
tgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtgggtttaattcgaagcaacgcgaagaagcttacctgggcttgacatgctgagaactttccagagatggattggtgccttcgggaactcagacacctggtgctgcatggctgtcgtcagctcgtgtcgtgagatgttgggttaagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 3267 - DNA, 1373 bp, Pseudomonas sp.
agaggagcttgctcctcgattcagcggcggacgggcgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacta

SEQ ID NO: 3268 - DNA, 1405 bp, Pseudomonas sp.
cacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacgg

SEQ ID NO: 3269 - DNA, 1410 bp, Pseudomonas sp.
tgcagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccactag

SEQ ID NO: 3270 - DNA, 1392 bp, Pseudomonas sp.
tcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacctcgggagga

SEQ ID NO: 3271 - DNA, 1387 bp, Pseudomonas sp.
cttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgag

SEQ ID NO: 3272 - DNA, 1411 bp, Pseudomonas sp.
gcagtcgagcggatgaagggagcttgctctctgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaacggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacgatg

SEQ ID NO: 3273 - DNA, 1397 bp, Pseudomonas sp.
agtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggaca

SEQ ID NO: 3274 - DNA, 1412 bp, Pseudomonas sp.
catgcagtcgagcggatgagaggagcttgctcctctgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgg

SEQ ID NO: 3275 - DNA, 1413 bp, Pseudomonas sp.
ccatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgga

SEQ ID NO: 3276 - DNA, 1408 bp, Pseudomonas sp.
caagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacga

SEQ ID NO: 3277 - DNA, 1405 bp, Pseudomonas sp.
gacagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtgggggagcaaacaggattagataccctggtagtccacgccgtaaacgatgtcaactagccgttgggatccttgagatcttagtggcgcagctaacgcattaagttgaccgcctgggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 3278 - DNA, 1406 bp, Pseudomonas sp.
acatgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggactct

SEQ ID NO: 3279 - DNA, 1412 bp, Pseudomonas sp.
acatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacta

SEQ ID NO: 3280 - DNA, 1409 bp, Pseudomonas sp.
gcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccactga

SEQ ID NO: 3281 - DNA, 1409 bp, Pseudomonas sp.
atgcagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccact

SEQ ID NO: 3282 - DNA, 1403 bp, Pseudomonas sp.
catgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacgg

SEQ ID NO: 3283 - DNA, 1406 bp, Pseudomonas sp.
cacatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaaccctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacg

SEQ ID NO: 3284 - DNA, 1405 bp, Pseudomonas sp.
tgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtac

SEQ ID NO: 3285 - DNA, 1416 bp, Pseudomonas sp.
acatgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcatatgaattgacgggggcccgcacaagcggtggagcatgtggtttaattcgaagcaacgcgaagaaccttacctgggccttgacatgctgagaactttccagagatggattgggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacgga

SEQ ID NO: 3286 - DNA, 1403 bp, Pseudomonas sp.
gcaagtcgagcggatgagaggggcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtt

SEQ ID NO: 3287 - DNA, 1396 bp, Pseudomonas sp.
gcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggagg

SEQ ID NO: 3288 - DNA, 1406 bp, Pseudomonas sp.
atgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctgggcatgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttac

SEQ ID NO: 3289 - DNA, 1384 bp, Pseudomonas sp.
gaagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggagga

SEQ ID NO: 3290 - DNA, 1406 bp, Pseudomonas sp.
atgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattgggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 3291 - DNA, 1404 bp, Curtobacterium sp.
cacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaaggcttgacatacaccggaaacggccagagatggttgcccccgttgtggtcggtgtacaggtggagcatggggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaatg

SEQ ID NO: 3292 - DNA, 1397 bp, Curtobacterium sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 3293 - DNA, 1395 bp, Curtobacterium sp.
ccatgcagtcgacgatgatgcccagcttgctgggtggattagtggcgaacgggtgagtaacacgtgagtaacctgcccctgactctgggataagcgttggaaacgacgtctaatactggatatgaccgccgatcgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggcagagatggtcgcccccttggtggtcggtgtacaggtggtgcatgggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 3294 - DNA, 1399 bp, Curtobacterium sp.
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaag

SEQ ID NO: 3295 - DNA, 1399 bp, Curtobacterium sp.
atgcagtcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggcctttccgggttgtaaacctcttttagtagggaagaaagcgaaagtgacggtaccttgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 3296 - DNA, 1382 bp, Curtobacterium sp.
tgtagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaagg

SEQ ID NO: 3297 - DNA, 1393 bp, Curtobacterium sp.
atgcaagtcgaacgatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccgggaaatgggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 3298 - DNA, 1389 bp, Curtobacterium sp.
cagcagtcgacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccga

SEQ ID NO: 3299 - DNA, 1337 bp, Curtobacterium sp.
attgctgggtggattagtggcgaacgggcgaaaaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagcc

SEQ ID NO: 3300 - DNA, 1390 bp, Curtobacterium sp.
acatgcaagtcgaacgatgatgcccagcttgctgggtggattagtggcgaacgggtgagtaacacgtgagtaacctgcccctgactctgggataagcgttggaaacgacgtctaatactggatatgactactggtcgcatggcctggtggtggaaagattctttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 3301 - DNA, 1397 bp, Curtobacterium sp.
taccatgcagtcgaacgatgatcaggagcttgctcttgtgattagtggcgaacgggtgagtaacacgtgagtaacctgcccctgactctgggataagcgttggaaacgacgtctaatactggataggactactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgcccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtcgtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 3302 - DNA, 1398 bp, Curtobacterium sp.
tacacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccgggaaacggccagagatggatcgccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtc

SEQ ID NO: 3303 - DNA, 1393 bp, Curtobacterium sp.
cacatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 3304 - DNA, 1390 bp, Curtobacterium sp.
catgcagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 3305 - DNA, 1400 bp, Curtobacterium sp.
acatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgcccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaata

SEQ ID NO: 3306 - DNA, 1394 bp, Curtobacterium sp.
acatgcagtcgaacgatgatgcccagcttgctgggtggattagtggcgaacgggtcgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtc

SEQ ID NO: 3307 - DNA, 1393 bp, Curtobacterium sp.
acatgcaagtcgaacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 3308 - DNA, 1363 bp, Curtobacterium sp.
gatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccct

SEQ ID NO: 3309 - DNA, 1365 bp, Curtobacterium sp.
gcgatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtaggggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccc

SEQ ID NO: 3310 - DNA, 1265 bp, Curtobacterium sp.
gattgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaac

SEQ ID NO: 3311 - DNA, 1373 bp, Curtobacterium sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctt

SEQ ID NO: 3312 - DNA, 1344 bp, Curtobacterium sp.
agattgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtatacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtgg

SEQ ID NO: 3313 - DNA, 1380 bp, Curtobacterium sp.
tgacagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctgggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 3314 - DNA, 1386 bp, Curtobacterium sp.
tgacagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggag

SEQ ID NO: 3315 - DNA, 1383 bp, Curtobacterium sp.
tcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 3316 - DNA, 1391 bp, Curtobacterium sp.
acatgcagtcgacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaatttcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 3317 - DNA, 1378 bp, Curtobacterium sp.
ccatgcagtcgacgatgatcaggagcttgctcttgtgattagtggcgaacgggtgagtaacacgtgagtaacctgcccctgactctgggataagcgttggaaacgacgtctaatactggataggactactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacgggcgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 3318 - DNA, 1371 bp, Curtobacterium sp.
gcagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaatactcaaaggaattgacgggggcccgcacaagcggcggagcatgcggattaattcgatgcaacgcgaagaaccttaccaaggcttgacatacaccggaaacagccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccc

SEQ ID NO: 3319 - DNA, 1379 bp, Curtobacterium sp.
acatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 3320 - DNA, 1381 bp, Curtobacterium sp.
ccatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggtaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 3321 - DNA, 1381 bp, Curtobacterium sp.
accatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtcccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 3322 - DNA, 1394 bp, Curtobacterium sp.
taccatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggttgccccctttgtggtccggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 3323 - DNA, 1381 bp, Curtobacterium sp.
gcatgcagtcgacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtgg

SEQ ID NO: 3324 - DNA, 1374 bp, Curtobacterium sp.
gcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctt

SEQ ID NO: 3325 - DNA, 1393 bp, Curtobacterium sp.
agtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccggaaacgggcagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaat

SEQ ID NO: 3326 - DNA, 1392 bp, Curtobacterium sp.
acatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaagcttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 3327 - DNA, 1394 bp, Curtobacterium sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccgggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggctcagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 3328 - DNA, 1402 bp, Curtobacterium sp.
tacacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaat

SEQ ID NO: 3329 - DNA, 1393 bp, Curtobacterium sp.
cacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 3330 - DNA, 1389 bp, Curtobacterium sp.
cacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcgggggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggag

SEQ ID NO: 3331 - DNA, 1400 bp, Curtobacterium sp.
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggctgagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaagg

SEQ ID NO: 3332 - DNA, 1374 bp, Curtobacterium sp.
agtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaaatcatgaaagtcggtaacacccgaagccggtggcctaacccttgt

SEQ ID NO: 3333 - DNA, 1388 bp, Curtobacterium sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggatcgccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 3334 - DNA, 1374 bp, Curtobacterium sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaacagtcggtaacacccgaagccggtggcctaaccctt

SEQ ID NO: 3335 - DNA, 1386 bp, Curtobacterium sp.
acacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtgga

SEQ ID NO: 3336 - DNA, 1393 bp, Curtobacterium sp.
tacacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaagagcc

SEQ ID NO: 3337 - DNA, 1392 bp, Curtobacterium sp.
acacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 3338 - DNA, 1367 bp, Curtobacterium sp.
acgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgt

SEQ ID NO: 3339 - DNA, 1384 bp, Curtobacterium sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgtggaagagccg

SEQ ID NO: 3340 - DNA, 1376 bp, Curtobacterium sp.
aagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 3341 - DNA, 1386 bp, Curtobacterium sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgtggaaggagccg

SEQ ID NO: 3342 - DNA, 1436 bp, Paenibacillus sp.
atacatgcagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagcccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaaggtcttgacatccctctgaccggtacagagatgtaccttttccttcgggacagaggagacaggtggtgcatgggttgtcgtcagctcgtgtcctgaagcatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaa

SEQ ID NO: 3343 - DNA, 1442 bp, Paenibacillus sp.
ctatacatgcaagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaaggtgacggtacctgagaagaaagccccggctaactacgtgcccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagagcagacaggtggtgcatggttgtcgtcagctcgtgtcgtgagatgttgggttaagtcccgcaaggagccgcgatcccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgg

SEQ ID NO: 3344 - DNA, 1441 bp, Paenibacillus sp.
ctatacatgcaagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgagcgggtacagagatgtaacgtttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgtt

SEQ ID NO: 3345 - DNA, 1436 bp, Paenibacillus sp.
aatacatgcagtcgagcggacttgcatgagaagcttgcttctctgatggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgcccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtgggtttaattcgaagcaacgcgaagaacccttaccaggtcttgacatccctctgaacgggtacagagatgtaacttttccttcgggacagaggacacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 3346 - DNA, 1429 bp, Paenibacillus sp.
tacatgcagtcgagcggacttgcatgagaagcttgcttctctgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtatctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaa

SEQ ID NO: 3347 - DNA, 1436 bp, Paenibacillus taichungensis
atacatgcagtcgagcggacttgcatgagaagcttgcttctctgatggttagcggcggacgggtgagtaacacgtaggcacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaagcgcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggttttattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgatc

SEQ ID NO: 3348 - DNA, 1434 bp, Paenibacillus sp.
atacatgcagtcgagcggacttgcatgagaagcttgcttctcatgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttagggggtttcgatacccttggtgccgaagttaacacattaagcactccgcctggggagtacaggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 3349 - DNA, 1425 bp, Paenibacillus sp.
gagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttgggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgat

SEQ ID NO: 3350 - DNA, 1393 bp, Paenibacillus sp.
tgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttagggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 3351 - DNA, 1407 bp, Paenibacillus sp.
agaagcttgcttctcatgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatgt

SEQ ID NO: 3352 - DNA, 1429 bp, Paenibacillus sp.
atactgcagtcgagcggacttgatgagaagcttgcttctctgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgatactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaag

SEQ ID NO: 3353 - DNA, 1433 bp, Paenibacillus sp.
tatacatgcagtcgagcggacttgcatgagaagcttgcttctcatgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacacccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccga

SEQ ID NO: 3354 - DNA, 1413 bp, Paenibacillus sp.
atgcatgagaagcttgcttctcatgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaat

SEQ ID NO: 3355 - DNA, 1437 bp, Paenibacillus sp.
tatacatgcagtcgagcggactatgcatgagaagcttgcttctcatgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 3356 - DNA, 1430 bp, Paenibacillus sp.
acatgcagtcgagcggacttgatgagaagcttgcttctctgatggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 3357 - DNA, 1431 bp, Paenibacillus sp.
acatgcaagtcgagcggacttgcatgagaagcttgcttctcatgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgata

SEQ ID NO: 3358 - DNA, 1388 bp, Erwinia sp.
ccatgcagtcgaacggcagcacagaatagcttgctctttgggtggcgagtggcggacgggtgagtaatgtctgggaaactgcccgatggagggggataactactggaaacggtagctaataccgcataacgtcgcaagaccagagtgggggaccttcgggcctcacgccatcggatgtgcccaaatgggattagctagtaggtggggtaatggctcacctaggcgacgatccctagctggtctgagaggatgaccagccacactggaactgagacacggtccatactcctacgggaggcggcaatggggaatattggacaatgggcgcaagcctgatgcacccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaacgcggccccctggaccaacactgacgctcacgtgcgatagcgtggggagcaaacaggattacataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactatgagacaggtgctgcatggccgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggta

SEQ ID NO: 3359 - DNA, 1420 bp, Pantoea sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcggtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagtagcttacctggccttgacatccagagaacatagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 3360 - DNA, 1422 bp, Pantoea sp.
tacacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctggccttgacatccagagaacttagcagagatgctttggtcgcttcgggaactctgagacaggtgctgcatggctgtcgtcagctcgtgtagtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacat

SEQ ID NO: 3361 - DNA, 1420 bp, Pantoea sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggctgtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgatgggataagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactg

SEQ ID NO: 3362 - DNA, 1419 bp, Pantoea sp.
ctaccatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggcttgacttccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacga

SEQ ID NO: 3363 - DNA, 1416 bp, Pantoea sp.
acacatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggcgagtacggccgcaaggttaaaactcaaatgaattgacgggggccccgcacaagcggtggagcatgtggtttaattcgatgcaacgcgaagaaccttacctgggccttgacatccagactagatagcagacatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctt

SEQ ID NO: 3364 - DNA, 1414 bp, Pantoea sp.
atgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggaggagcatgtggtttaattcgatgcaacgcgaagaaccttacctgggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagtgtagcttaaccttcgggagggcgctaccag

SEQ ID NO: 3365 - DNA, 1417 bp, Pantoea sp.
catgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacgggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttc

SEQ ID NO: 3366 - DNA, 1419 bp, Erwinia sp.
acatgcaagtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatatt

SEQ ID NO: 3367 - DNA, 1365 bp, Erwinia sp.
taagcttgctcttcgggtgacgagtggcggacgggtgagtaatgtctgggaaactgcccgatggcgggggataactactggaaacggtagctaataccgcataacgtcgcaagaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtaaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggctttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgggtagtgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagtaa

SEQ ID NO: 3368 - DNA, 1405 bp, Erwinia sp.
gcaagtcggacggtagcacagaagagcttgctcttcgggtgacgagtggcggacgggtgagtaatgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccacggaacttggcagagatgccttggtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctccgggagggc

SEQ ID NO: 3369 - DNA, 1410 bp, Erwinia sp.
tgcagtcggacggtagcacagaagagcttgctcttcgggtgacgagtggcggacgggtgagtaatgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctgggggagtacggccgcaaggttaaaactcaaatgaattgacgggggcccgcacaagcggtggagcatgtggtttaattcgatgcaacgcgaagaaccttacctggccttgacatccacggaacttggcagagatgccttggtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccgatgggagtgggttgcaaaagaagtaggtagcttaaccttcgggagggcgcct

SEQ ID NO: 3370 - DNA, 1337 bp, Unknown
  Description of Unknown: bacterium polynucleotide
  Methylobacteriaceae
cacatgcaagtcgagcgggcatccttgtggtgtcagcggcagacgggtgagtaacgcgtgggaacgtgcccttcggttcggaataactcagggaaacttgagctaataccggatacgtgcgagagcagaaaggtttactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgcgagccggagagatccggtgttcccttcggggacgtgcacacaggtgctgcatggctgtcgtcagctcgtgtcgtgagatgttgggttaagtcccgcaacgagcgcaacccacgtcctcagttgccatcatttggttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgc

SEQ ID NO: 3371 - DNA, 1334 bp, Ochrobactrum sp.
catagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggacgggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggtttacccgaaggcgctgtgctaa

SEQ ID NO: 3372 - DNA, 1367 bp, Ochrobactrum sp.
catagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttgggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgaagatgattgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactatagt

SEQ ID NO: 3373 - DNA, 1356 bp, Ochrobactrum sp.
atagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtccac

SEQ ID NO: 3374 - DNA, 1363 bp, Ochrobactrum sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaacccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggttacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactata

SEQ ID NO: 3375 - DNA, 1356 bp, Ochrobactrum sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccact

SEQ ID NO: 3376 - DNA, 1357 bp, Ochrobactrum sp.
acatagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 3377 - DNA, 1351 bp, Ochrobactrum sp.
aagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 3378 - DNA, 1357 bp, Ochrobactrum sp.
acatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 3379 - DNA, 1357 bp, Ochrobactrum sp.
catgcaagtcgagcgccccgcaaggggagcggcagacgggtgagtaacgcgtgggcaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaacgcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 3380 - DNA, 1364 bp, Ochrobactrum sp.
acacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtag

SEQ ID NO: 3381 - DNA, 1351 bp, Ochrobactrum sp.
tgacagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctgggggagtacggtcgcaagattaaaactcaaaggaattgacgggggcccgcacaagcggtggagcatgtggtttaattcgaagcaacgcgcagaacccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcagtc

SEQ ID NO: 3382 - DNA, 1362 bp, Ochrobactrum sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacgtac

SEQ ID NO: 3383 - DNA, 1357 bp, Ochrobactrum sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 3384 - DNA, 1351 bp, Ochrobactrum sp.
agacagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacggcggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgt

SEQ ID NO: 3385 - DNA, 1350 bp, Ochrobactrum sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgt

SEQ ID NO: 3386 - DNA, 1355 bp, Ochrobactrum sp.
atagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggagagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacc

SEQ ID NO: 3387 - DNA, 1363 bp, Ochrobactrum sp.
ttaccatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgcccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactg

SEQ ID NO: 3388 - DNA, 1345 bp, Ochrobactrum sp.
tgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaacctgcaaggagg

SEQ ID NO: 3389 - DNA, 1343 bp, Ochrobactrum sp.
cgtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcagggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaatactcaaaggaattgacgggggcccgcacaagcggtggagcatgtggtttaattcgaagcaacgcgcagaaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggc

SEQ ID NO: 3390 - DNA, 1361 bp, Ochrobactrum sp.
cacatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacta

SEQ ID NO: 3391 - DNA, 1351 bp, Ochrobactrum sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtc

SEQ ID NO: 3392 - DNA, 1356 bp, Ochrobactrum sp.
ctagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaagcaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgt

SEQ ID NO: 3393 - DNA, 1355 bp, Ochrobactrum sp.
atagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 3394 - DNA, 1352 bp, Ochrobactrum sp.
aagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccac

SEQ ID NO: 3395 - DNA, 1360 bp, Ochrobactrum sp.
catgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgc

SEQ ID NO: 3396 - DNA, 1399 bp, Stenotrophomonas sp.
ggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttatttaagtccgttgtgaaagcccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcagttagcttaaccttcgggagggcgc

SEQ ID NO: 3397 - DNA, 1430 bp, Bacillus sp.
atacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaacccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctatg

SEQ ID NO: 3398 - DNA, 1405 bp, Achromobacter sp.
ccatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcggatgagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 3399 - DNA, 1403 bp, Achromobacter sp.
atgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcatgagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 3400 - DNA, 1391 bp, Achromobacter sp.
cgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaacgcagcctcctgggataacactgacgctcatgcacgatagcgtggggagcaaacaggattagataccctggtagtccacgccctaaacgatgtcaactagctgttggggccttcgggccttgctagcgcagctaacgcgtgaagttgaccgcctggggagtacggtcgcaagattaatactcaaaggaattgacggggacccgcacaagcggtggatgatgtggattaattcgatgcaacgcgaaaaagcttacctacccttgacatgtctggaattccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgata

SEQ ID NO: 3401 - DNA, 1409 bp, Achromobacter sp.
taccatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 3402 - DNA, 1406 bp, Achromobacter sp.
ccatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 3403 - DNA, 1410 bp, Achromobacter sp.
taccatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 3404 - DNA, 1407 bp, Achromobacter sp.
accatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 3405 - DNA, 1409 bp, Achromobacter sp.
accatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcatacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactgt

SEQ ID NO: 3406 - DNA, 1390 bp, Achromobacter sp.
aacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcggat

SEQ ID NO: 3407 - DNA, 1401 bp, Achromobacter sp.
aagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactg

SEQ ID NO: 3408 - DNA, 1393 bp, Achromobacter sp.
agtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgta

SEQ ID NO: 3409 - DNA, 1413 bp, Achromobacter sp.
cttaccatgcagtcgacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggtttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggtag

SEQ ID NO: 3410 - DNA, 1402 bp, Achromobacter sp.
atgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgaatacca

SEQ ID NO: 3411 - DNA, 1399 bp, Achromobacter sp.
caagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 3412 - DNA, 1406 bp, Achromobacter sp.
caagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccgggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacgtaga

SEQ ID NO: 3413 - DNA, 1399 bp, Achromobacter sp.
atgacagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgat

SEQ ID NO: 3414 - DNA, 1394 bp, Achromobacter sp.
aacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacg

SEQ ID NO: 3415 - DNA, 1412 bp, Achromobacter sp.
ctcatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggtagat

SEQ ID NO: 3416 - DNA, 1396 bp, Achromobacter sp.
cgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccact

SEQ ID NO: 3417 - DNA, 1398 bp, Achromobacter sp.
atgacagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggtttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcga

SEQ ID NO: 3418 - DNA, 1400 bp, Achromobacter sp.
cgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacgtaga

SEQ ID NO: 3419 - DNA, 1399 bp, Achromobacter sp.
gcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 3420 - DNA, 1398 bp, Achromobacter sp.
cgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggt

SEQ ID NO: 3421 - DNA, 1402 bp, Achromobacter sp.
tcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtgggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactgta

SEQ ID NO: 3422 - DNA, 1407 bp, Achromobacter sp.
gcatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 3423 - DNA, 1397 bp, Achromobacter sp.
cagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatac

SEQ ID NO: 3424 - DNA, 1422 bp, Enterobacter sp.
cacatgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaaccctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatgggatttggtgccttcgggaactgtgagacaggtgctgcatggctgtcgtcagctcgtgttgtgaaatgttgggataagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaaactcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactt

SEQ ID NO: 3425 - DNA, 1407 bp, Enterobacter sp.
tcgacggtacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgcccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaagggttaaaactcaaatgaattgacgggggcccgcacaagcggtggagcatgtggtttaattcgatgcaacgcgaagaaccttacctggtcttgacatccacagaacttggcagagatgcaaaggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctactc

SEQ ID NO: 3426 - DNA, 1413 bp, Enterobacter sp.
tgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaaccctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatgcgttggtgccttcgggtactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccac

SEQ ID NO: 3427 - DNA, 1430 bp, Bacillus sp.
tacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtcccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcggggcacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaatg

SEQ ID NO: 3428 - DNA, 1432 bp, Bacillus sp.
acatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaacccagaaagccaacggctaactacgtgccagcagccgcggtaatacgtaggtggcaagcgttgtccggaattattgggcgtaaagcgcgcgcaggtggttcccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaagt

SEQ ID NO: 3429 - DNA, 1433 bp, Bacillus sp.
atactgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgcccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggcgagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttcccctttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaagtgac

SEQ ID NO: 3430 - DNA, 1426 bp, Bacillus sp.
gcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaaagccacggctaactacgtgccagcagccgcggtaatacgtaggtggcaagcgttgtccggaattattgggcgtaaagcgcgcgcaggtggttcctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccagggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 3431 - DNA, 1429 bp, Bacillus sp.
tacatgcaagtcgagcgaatcagatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggcgtcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 3432 - DNA, 1429 bp, Bacillus sp.
ataatgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttcctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtgggagcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 3433 - DNA, 1440 bp, Bacillus sp.
ctatactgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccaccggctaactacgtgcccagcagccgcggtaatacgtaggtttggcaagcgattagaccggaattattggggccgtaaacccccccggctggaggttcccttactctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaagg

SEQ ID NO: 3434 - DNA, 1421 bp, Bacillus simplex
atgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaatttccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaacgatcccgttctaccttaccaggtgatgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcc

SEQ ID NO: 3435 - DNA, 1421 bp, Bacillus sp.
atgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcct

SEQ ID NO: 3436 - DNA, 1427 bp, Bacillus sp.
tatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaacccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgc

SEQ ID NO: 3437 - DNA, 1358 bp, Methylobacterium sp.
aagcagtcgagcggacctttcggggtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggttgaaagcctgtggctcaacccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggcgagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgtccac

SEQ ID NO: 3438 - DNA, 1360 bp, Methylobacterium sp.
ccatgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtactcggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 3439 - DNA, 1363 bp, Methylobacterium sp.
atgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttaggggttgtaaagctcttttattccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcatttagttggggcactcttcggagactggcggtgattagccgcgaggaaggagtgggatgacgtcaaggtcctcatgggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 3440 - DNA, 1362 bp, Methylobacterium sp.
taccatgcagtcgagcggacctttcggggtcagcggcggacgggtgagtaacgcgtgggaacgtgccttctggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacgat

SEQ ID NO: 3441 - DNA, 1335 bp, Methylobacterium sp.
ttcgggagtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatcccgggacgataatgacggtaccgggaggaataagccccggctaacttcgtgcccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcagtc

SEQ ID NO: 3442 - DNA, 1352 bp, Methylobacterium sp.
tgacagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgggccaaccgcaaggaggcaggcgt

SEQ ID NO: 3443 - DNA, 1349 bp, Methylobacterium sp.
acagtcgagcgggcccttcgggagtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtgcacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggta

SEQ ID NO: 3444 - DNA, 1213 bp, Methylobacterium sp.
gctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcagccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcactagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcttcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagtt

SEQ ID NO: 3445 - DNA, 1352 bp, Methylobacterium sp.
tgacagtcgagcggacctttcgggagtcagcggcggacgggtgagtaacgcgtgggaacgtgccttccggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggtg

SEQ ID NO: 3446 - DNA, 1299 bp, Methylobacterium sp.
tcagcggcggacgggtgagtaacgcgtggtaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcg

SEQ ID NO: 3447 - DNA, 1337 bp, Methylobacterium sp.
gacagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaacctgc

SEQ ID NO: 3448 - DNA, 1356 bp, Methylobacterium sp.
catgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgtcca

SEQ ID NO: 3449 - DNA, 1354 bp, Methylobacterium sp.
cagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaaggggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccac

SEQ ID NO: 3450 - DNA, 1388 bp, Burkholderia sp.
gaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctgcaaggagga

SEQ ID NO: 3451 - DNA, 1394 bp, Burkholderia sp.
gaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 3452 - DNA, 1390 bp, Burkholderia sp.
agcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctgcaag

SEQ ID NO: 3453 - DNA, 1405 bp, Burkholderia sp.
catgcagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtctacc

SEQ ID NO: 3454 - DNA, 1403 bp, Burkholderia sp.
accatgcagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtca

SEQ ID NO: 3455 - DNA, 1401 bp, Burkholderia sp.
atgcagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 3456 - DNA, 1406 bp, Burkholderia sp.
cacatgcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 3457 - DNA, 1409 bp, Burkholderia sp.
taccatgcaagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 3458 - DNA, 1403 bp, Burkholderia sp.
cgcatgcagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtc

SEQ ID NO: 3459 - DNA, 1395 bp, Burkholderia sp.
cagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacgg

SEQ ID NO: 3460 - DNA, 1401 bp, Burkholderia sp.
gcagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtaggggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 3461 - DNA, 1390 bp, Burkholderia sp.
gaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacgc

SEQ ID NO: 3462 - DNA, 1403 bp, Bacillus sp.
accatgcaagtcgaacgatgaagcccagcttgctgggtggattagtggcgaacgggtgagtaacacgtgagcaacctgcccctgactctgggataagcgctggaaacggtgtctaatactggatatgtcccatcaccgcatggtgtgtgggtggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgagagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaattccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtgggggagcaaacaggcttagataccctggtagtccaccccgtaaacgttgggaactagttgtggggtcctttccacggattccgtgacgcagctaacgcattaagttccccgcctggggagtacggccgcaaggctaatactcaaaggaattgacggggacccgcacaagcggcggagcatgcggattaattcgatgcaacgcgaagaaccttaccaaggcttgacatacacgagaacgggccagaaatggtcaactctttcgacactcgtgaacagcaggtgcatggttgtcgtcagctcgtgtcgtggacaagttgggttatgtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaagg

SEQ ID NO: 3463 - DNA, 1364 bp, Microbacterium sp.
cgatgaacctggagcttgctctgggggattagtggcgaacgggtgagtaacacgtgagcaacctgcccctgactctgggataagcgctggaaacggcgtctaatactggatacgaacaagaatcgcatggttacttgttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacggaccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaac

SEQ ID NO: 3464 - DNA, 1397 bp, Microbacterium sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcgatggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaa

SEQ ID NO: 3465 - DNA, 1396 bp, Microbacterium sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcga

SEQ ID NO: 3466 - DNA, 1397 bp, Microbacterium sp.
ccatgcaagtcgaacgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaa

SEQ ID NO: 3467 - DNA, 1389 bp, Microbacterium sp.
tgacagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagc

SEQ ID NO: 3468 - DNA, 1399 bp, Microbacterium sp.
tacacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaacccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 3469 - DNA, 1364 bp, Microbacterium sp.
gacagtcgacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggt

SEQ ID NO: 3470 - DNA, 1398 bp, Microbacterium sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtgggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 3471 - DNA, 1395 bp, Microbacterium sp.
catgcaagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatcctggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgt

SEQ ID NO: 3472 - DNA, 1382 bp, Microbacterium sp.
gaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggtaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagc

SEQ ID NO: 3473 - DNA, 1400 bp, Microbacterium sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaacgttaccaagggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 3474 - DNA, 1359 bp, Microbacterium sp.
gaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagaaccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtg

SEQ ID NO: 3475 - DNA, 1394 bp, Microbacterium sp.
ccatgcagtcgaacgatgaacctggagcttgctctgggggattagtggcgaacgggtgagtaacacgtgagcaacctgcccctgactctgggataagcgctggaaacggcgtctaatactggatacgaacaagaatcgcatggttacttgttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacggaccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagtcg

SEQ ID NO: 3476 - DNA, 1391 bp, Microbacterium sp.
aagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 3477 - DNA, 1398 bp, Microbacterium sp.
accatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacgggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 3478 - DNA, 1386 bp, Microbacterium sp.
aagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccg

SEQ ID NO: 3479 - DNA, 1364 bp, Microbacterium sp.
acggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggcgtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaac

SEQ ID NO: 3480 - DNA, 1366 bp, Microbacterium sp.
acggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaaccctt

SEQ ID NO: 3481 - DNA, 1397 bp, Microbacterium sp.
accatgcaagtcgaacggtgaagccaagcttgcttggtggatcagtggcgaacgggtgagtaacacgtgagcaacctgccctggactctgggataagcgctggaaacggcgtctaatactggatatgagctcctatcgcatggtgggggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaaggcttgacatacatcagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcg

SEQ ID NO: 3482 - DNA, 1393 bp, Microbacterium sp.
cacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttcgccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagcc

SEQ ID NO: 3483 - DNA, 1401 bp, Microbacterium sp.
tacacatgcaagtcgaacggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaat

SEQ ID NO: 3484 - DNA, 1422 bp, Xanthomonas sp.
accatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatggtaggtttaattcgatgcaacgcgttctaccttacctggtcttgacatccacggaaccttgcagagatggattggtgcctttcggtagcgtgagacacgtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 3485 - DNA, 1426 bp, Xanthomonas sp.
taccatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgcccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtgggtttaattcgatgcaacgcgaagaacccttacctgggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 3486 - DNA, 1412 bp, Xanthomonas sp.
tgacagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttgggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgta

SEQ ID NO: 3487 - DNA, 1422 bp, Xanthomonas sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtggggacagagggctgcaagccggcgacggtaagccaatcccagaaaccccatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 3488 - DNA, 1422 bp, Xanthomonas sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacta

SEQ ID NO: 3489 - DNA, 1415 bp, Xanthomonas sp.
gcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 3490 - DNA, 1424 bp, Xanthomonas sp.
acatgcagtcgaacggcagcaacaggagagcttgctctctgggtggcgagtggcggacgaggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtgggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 3491 - DNA, 1422 bp, Xanthomonas sp.
cacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaaccctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 3492 - DNA, 1424 bp, Xanthomonas sp.
cacatgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagcccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 3493 - DNA, 1423 bp, Xanthomonas sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaaagggtgcaagcgttactcggaattactgggcgtaaagcgtgcgtaggtggttgtttaagtccgttgtgaaagccctgggcttaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaagcttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 3494 - DNA, 1412 bp, Xanthomonas sp.
catgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactttaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgct

SEQ ID NO: 3495 - DNA, 1416 bp, Xanthomonas sp.
tgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggtatggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccac

SEQ ID NO: 3496 - DNA, 1369 bp, Rhodococcus sp.
agacagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaacc

SEQ ID NO: 3497 - DNA, 1341 bp, Rhodococcus sp.
ttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtc

SEQ ID NO: 3498 - DNA, 1386 bp, Rhodococcus sp.
tagcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagttcacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccta

SEQ ID NO: 3499 - DNA, 1387 bp, Rhodococcus sp.
atgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagcctac

SEQ ID NO: 3500 - DNA, 1393 bp, Rhodococcus sp.
cacatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaa

SEQ ID NO: 3501 - DNA, 1383 bp, Rhodococcus sp.
tgacagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctataactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggag

SEQ ID NO: 3502 - DNA, 1363 bp, Rhodococcus sp.
tgacagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtc

SEQ ID NO: 3503 - DNA, 1379 bp, Rhodococcus sp.
aagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggag

SEQ ID NO: 3504 - DNA, 1383 bp, Rhodococcus sp.
gacagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagcc

SEQ ID NO: 3505 - DNA, 1384 bp, Rhodococcus sp.
gcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggagccg

SEQ ID NO: 3506 - DNA, 1383 bp, Rhodococcus sp.
tgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttcctttccacggaatccgtgccgtagctaacgcattaagcgcccggcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagc

SEQ ID NO: 3507 - DNA, 1390 bp, Rhodococcus sp.
acatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcg

SEQ ID NO: 3508 - DNA, 1366 bp, Rhodococcus sp.
agtcgagcggtaggcctttcggggtcacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcgtgaaagtcggtaacacccgaagccggtggcttaaccccttg

SEQ ID NO: 3509 - DNA, 1387 bp, Rhodococcus sp.
actgcagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggagcc

SEQ ID NO: 3510 - DNA, 1388 bp, Rhodococcus sp.
ccatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtcccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccg

SEQ ID NO: 3511 - DNA, 1383 bp, Rhodococcus sp.
atgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagc

SEQ ID NO: 3512 - DNA, 1389 bp, Rhodococcus sp.
cttgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtc

SEQ ID NO: 3513 - DNA, 1389 bp, Rhodococcus sp.
accatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgt

SEQ ID NO: 3514 - DNA, 1406 bp, Acidovorax sp.
taccatgcagtcgaacggtaacaggtcttcggatgctgacgagtggcgaacgggtgagtaatacatcggaacgtgcccgatcgtgggggataacgaggcgaaagctttgctaataccgcataagatctatggatgaaagcaggggaccgcaaggccttgcgcgaacggagcggccgatggcagattaggtagttggtggggtaaaggcttaccaagcctacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagccttcttctaataaagggaggtcatgacggtaccgtaagaataagcaccggctaactacgtgccagcagccgcggtaatacgtagggtgcaagcgttaatcggaattactgggcgtaaagcgtgcgcaggcggtgatgtaagacagatgtgaaatccccgggctcaacctgggaactgcatttgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgctaccacta

SEQ ID NO: 3515 - DNA, 1401 bp, Acidovorax sp.
cacatgcaagtcgaacggtaacaggtcttcggatgctgacgagtggcgaacgggtgagtaatacatcggaacgtgcccaagagtgggggataacggagcgaaagctttgctaataccgcatacgatctacggatgaaagcaggggaccgcaaggccttgcgctcatggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagcctctttctaataaagaggggtcatgacggtaccgtaagaataagcaccggctaactacgtgccagcagccgcggtaatacgtagggtgcgagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgctca

SEQ ID NO: 3516 - DNA, 1400 bp, Burkholderia phytofirmans
cctgcagtcgaacggcagcacgggggcaccctggtggcgagtggcgaacgggtgagtaatacatcggaacgtgtcctgtagtgggggatagcccggcgaaagccggattaataccgcatacgatctgtggatgaaagcgggggatcttaggacctcgcgctacaggggcggccgatggcagattagctagttggtggggtaaaggcctaccaaggcgacaatatgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctcttggttaatacctgagggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaatttccacgtgtagcagtgaaatgcgtagagatgtggaggaataccgatggcgaaggctgccccctgggccaatactgacgctcatgcacgaaagcgtggggagcaaacaggattagataccctggtagtccacgccctaaacgatgtcaactagttgtcgggtcttcattgacttggtaacgtagcttacgcgtgaagttgaccgcctggggagtacggtcgcaagaataaaactcaaaggaattgacggggacccgcacaagcggtggatgatgtggattaattcgatgcaacgcgaaaaaccatacctacccatgacatgtatggaatcctgctgacacgagggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtct

SEQ ID NO: 3517 - DNA, 1429 bp, Bacillus sp.
tatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtcccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaa

SEQ ID NO: 3518 - DNA, 1419 bp, Bacillus sp.
ctacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcc

SEQ ID NO: 3519 - DNA, 1423 bp, Bacillus sp.
tacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccga

SEQ ID NO: 3520 - DNA, 1419 bp, Bacillus sp.
catgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagtagcttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctct

SEQ ID NO: 3521 - DNA, 1428 bp, Bacillus sp.
tgctatacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagtagcttaccaggtcttgacatcctctgacaatcctagagataggacgtccccttcgggggcagagtgacaggtcgtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccg

SEQ ID NO: 3522 - DNA, 1407 bp, Bacillus sp.
agcagtcgagcggacagatgggtagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtcgtgcatggttgtcgtcagctcgtgtcgtgagatgttgggttaagtcccgcaacgagcgcatcccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttag

SEQ ID NO: 3523 - DNA, 1428 bp, Bacillus sp.
acatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaacccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaaggtcttgacatcctctgacaatcctagagataggacgtccccttcgggggcagagtgacaggaggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 3524 - DNA, 1428 bp, Bacillus sp.
ctatacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccgggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataaggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccg

SEQ ID NO: 3525 - DNA, 1429 bp, Bacillus sp.
atacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtgggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 3526 - DNA, 1428 bp, Bacillus sp.
tatacatgcagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 3527 - DNA, 1426 bp, Bacillus sp.
catgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaatg

SEQ ID NO: 3528 - DNA, 1348 bp, Sphingomonas sp.
aacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgtac

SEQ ID NO: 3529 - DNA, 1366 bp, Sphingomonas sp.
catgcaagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagcccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaaacacaggtgctgcatggctgtcgtcagctcgtgtcgtgagatgttggggttaagtccccgaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 3530 - DNA, 1366 bp, Sphingomonas sp.
accatgcagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggtctaactccgtgccagcagccgcggtaatacggagggggctagcgttgttcggaattactgggcgtaaagcgcacgtaggcggctttgtaagtcagaggtgaaagccctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 3531 - DNA, 1354 bp, Sphingomonas sp.
aacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttggggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggaagcaggcgaccacgtgt

SEQ ID NO: 3532 - DNA, 1365 bp, Sphingomonas sp.
cacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagcccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgt

SEQ ID NO: 3533 - DNA, 1369 bp, Sphingomonas sp.
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgtc

SEQ ID NO: 3534 - DNA, 1368 bp, Sphingomonas sp.
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgt

SEQ ID NO: 3535 - DNA, 1363 bp, Sphingomonas sp.
acatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggataagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacag

SEQ ID NO: 3536 - DNA, 1368 bp, Sphingomonas sp.
tacacatgcaagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 3537 - DNA, 1358 bp, Sphingomonas sp.
cacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggaagcaggcgac

SEQ ID NO: 3538 - DNA, 1347 bp, Sphingomonas sp.
gcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaaggaagca

SEQ ID NO: 3539 - DNA, 1364 bp, Sphingomonas sp.
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagccctggagctcaactccagaactgcctttgagactgcatcgcttgaatcccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactgggaaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaaggaagcaggcgacc

SEQ ID NO: 3540 - DNA, 1378 bp, Sphingobium sp.
cagtctatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtggggtaaaggcccaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtgggagacactttccttcagttcggctggataggtgacaggtgctgcatggctgtcgtcagctcgtgtcgtgagatgttggggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgta

SEQ ID NO: 3541 - DNA, 1415 bp, Enterobacter sp.
accatgcagtcgacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 3542 - DNA, 1406 bp, Unknown
  Description of Unknown: bacterium polynucleotide
  Enterobacteriaceae
cgtacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttgcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 3543 - DNA, 1394 bp, Micrococcus sp.
gcatgcagtcgacgatgaagcccagcttgctgggtggattagtggcgaacgggtgagtaacacgtgagtaacctgcccttaactctgggataagcctgggaaactgggtctaataccggatatgagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagtagcttaccaaggcttgacatgtactcgatcggcgtagagatacggtttcccgttaggggcgggttctgtggtggtgcatggttgtcgtcagctcgtgtcgtgagatgttgggttaagtcccgcaacgagcgcaaccctcgttccatgttgccagcacgtcgtggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtac

SEQ ID NO: 3544 - DNA, 1356 bp, Agrobacterium sp.
catgcagtcgaacgcatcgcagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcagaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattgggagacgatgaccttcagttcggctggccctagaacaggtgctgcatggctgtcgtcagctcgtgtcgtgagatgttgggataagtcccgcaacgagcgcaaccctcccgcatagttggcagcatttagttgggctctctatcgggactgccggtgatatccgcagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgacc

SEQ ID NO: 3545 - DNA, 1355 bp, Agrobacterium tumefaciens
atagcagtcgacgccccgcaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctgggcccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctatcca

SEQ ID NO: 3546 - DNA, 1365 bp, Agrobacterium sp.
cacatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggcccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgta

SEQ ID NO: 3547 - DNA, 1343 bp, Agrobacterium sp.
tcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccaca

SEQ ID NO: 3548 - DNA, 1362 bp, Agrobacterium sp.
ccatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgt

SEQ ID NO: 3549 - DNA, 1412 bp, Staphylococcus sp.
cagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagcccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtgggagatcaaacaggattagataccctggtagtccacgccgtaaacgatgagtgctaagtgttagggggtttccgccccttagtgctgcagctaacgcattaagcactccgcctggggagtacgaccgcatggttgaaactcaaaggaattgacggggacccgcacaagcggtggagcatgtggtttaattcgaagcaacgcgaagtaccttaccaaatcttgacatcctctgacccctctagagatagagttttccccttcgggggacagagtgacaggtggtgcatggttgtcgtcagctcgtgtcgtgagatgatgggttatcacccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccgttggagtaaccatttggagct

SEQ ID NO: 3550 - DNA, 1426 bp, Staphylococcus sp.
tacatgcaagtcgagcgaacagacgaggagcttgctcctttgacgttagcggcggacgggtgagtaacacgtgggtaacctacctataagactgggataacttcgggaaaccggagctaataccggataatatttcgaaccgcatggttcgatagtgaaagatggctctgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacatgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcga

SEQ ID NO: 3551 - DNA, 1389 bp, Staphylococcus sp.
agacgaggagcttgctcctttgacgttagcggcggacgggtgagtaacacgtgggtaacctacctataagactgggataacttctggaaaccggagctaataccggataatatttcgaaccgcatggttcgatagtgaaagatggctctgctatcacttatagatggacctgcgccgtattatctagttggtaaggtaacggcttaccaaggcaacgatacgtagccgacctgagagggtgatcggccacactggaactgagacacgggccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtctctccggcgagagtttgtaacacccgaagccggtggagtaacca

SEQ ID NO: 3552 - DNA, 1426 bp, Bacillus sp.
taatgcaagtcgagcggactttaaaagcttgcttttaaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaatctgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattaagttgggcactttaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaagg

SEQ ID NO: 3553 - DNA, 1424 bp, Bacillus sp.
tacatgcagtcgagcggacttaaaaagcttgctttttaagttagcggcggacgggtgagtaacacgtgggcaacctgcctgtaagactgggataacttcgggaaaccggagctaataccggataatcctttcctactcatgtaggaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccgggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcct

SEQ ID NO: 3554 - DNA, 1422 bp, Luteibacter sp.
catgcagtcgaacggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccggcggtaatacggaggggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtgggagtatgtggtttaattcgatgcaacgcgaagaaccttacctgggcatgacatgtccggaatcctgcagagatgcgggagtgccttcgggaatcggaacacagctgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacg

SEQ ID NO: 3555 - DNA, 1423 bp, Luteibacter sp.
aacacatgcaagtcgaacggcagcaacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgacc

SEQ ID NO: 3556 - DNA, 1361 bp, Unknown
  Description of Unknown: bacterium polynucleotide
  Enterobacteriaceae
agcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaa

SEQ ID NO: 3557 - DNA, 1358 bp, Unknown
  Description of Unknown: bacterium polynucleotide
  Enterobacteriaceae
ttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaa

SEQ ID NO: 3558 - DNA, 1355 bp, Unknown
  Description of Unknown: bacterium polynucleotide
  Enterobacteriaceae
ttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaga

SEQ ID NO: 3559 - DNA, 1361 bp, Unknown
  Description of Unknown: bacterium polynucleotide
  Enterobacteriaceae
gcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaga

SEQ ID NO: 3560 - DNA, 1335 bp, Unknown
  Description of Unknown: bacterium polynucleotide
  Enterobacteriaceae
gatgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtagg

SEQ ID NO: 3561 - DNA, 1396 bp, Erwinia sp.
cacatgcagtcggacggtagcacagagagagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagctta

SEQ ID NO: 3562 - DNA, 1381 bp, Unknown
  Description of Unknown: bacterium polynucleotide
  Enterobacteriaceae
gagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaacctccgggagggc

SEQ ID NO: 3563 - DNA, 1418 bp, Unknown
  Description of Unknown: bacterium polynucleotide
  Enterobacteriaceae
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccact

SEQ ID NO: 3564 - DNA, 1422 bp, Unknown
  Description of Unknown: bacterium polynucleotide
  Enterobacteriaceae
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttt

SEQ ID NO: 3565 - DNA, 1416 bp, Unknown
  Description of Unknown: bacterium polynucleotide
  Enterobacteriaceae
acatgcagtcggacggtagcacagagaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgctaccacg

SEQ ID NO: 3566 - DNA, 1412 bp, Unknown
  Description of Unknown: bacterium polynucleotide
  Enterobacteriaceae
caagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaagggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccat

SEQ ID NO: 3567 - DNA, 1405 bp, Unknown
  Description of Unknown: bacterium polynucleotide
  Enterobacteriaceae
gcagtcggacggtagcacagaggagctttgctcctcgggtgacgagtggcggcacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgactttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtctcaccatgggagtgggttgcaaaagaagtaggtagcttaaccttcgggaggg

SEQ ID NO: 3568 - DNA, 1415 bp, Unknown
  Description of Unknown: bacterium polynucleotide
  Enterobacteriaceae
catgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggatctaattccaggtgtagcggtgaaatgcgtagagatctggaggaataccggtggcgaaggcggccccctggacgaagactgacgctcacgtgcgaaagcgtggggagcaaacacgattacataccctggtagtccacgccgtatacgatgtcgacttggaggttgttcccttgacgagtgccttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacagcacatgggagtgggttgcaaaagaagtaggtagcttaacctccgggagggcgctta

SEQ ID NO: 3569 - DNA, 1395 bp, Unknown
  Description of Unknown: bacterium polynucleotide
  Enterobacteriaceae
atgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtctatccatgggagtgggttgcaaaagaagtaggtagctaactc

SEQ ID NO: 3570 - DNA, 1416 bp, Pantoea sp.
acatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaatactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccgt

SEQ ID NO: 3571 - DNA, 1417 bp, Unknown
  Description of Unknown: bacterium polynucleotide
  Enterobacteriaceae
acatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccata

SEQ ID NO: 3572 - DNA, 1408 bp, Microbacterium sp.
accatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttgggacactcgtaaacaggtgggtgcatgggtagtcgtcagctcgtgtcgtgagatgttggggttaagtcccgcaacgagcgcaaccctcgttctatgttgccagcacgtaatggaggggaactcatggggaaactgccggggtgaactcggcaggaacgaggggtagacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtg

SEQ ID NO: 3573 - DNA, 1399 bp, Microbacterium sp.
ccatgcagtcgacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaaggcttgacatatacgagaacgggccagaaatgggacaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaatg

SEQ ID NO: 3574 - DNA, 1401 bp, Microbacterium sp.
ttaccatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtgggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaat

SEQ ID NO: 3575 - DNA, 1395 bp, Microbacterium sp.
ccatgcaagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttgggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtc

SEQ ID NO: 3576 - DNA, 1433 bp, Bacillus sp.
tatacatgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgcttgtaccttgacggtacctaacccagaaagccacggctaactacgtgccagcagccgcggtaatacgtaggtggcaagcgttatcccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccagggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaa

SEQ ID NO: 3577 - DNA, 1415 bp, Pantoea sp.
tagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacagtgggcgcaagcctgatgcacccatgccgcgtgtatgaagaaggccttcgggttgtaaagtactttcagcggggaggaaggcgatgaggttaataaccttgttgattgacgttacccgcagaagaagcacccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcacgtgcgaaagcgtggggagcaaacacgattagataccctggtagtccacgccgtaaacgatgtcgacttggaggttgttcccttgacgagtggcttccggagctaacgcgttaagtcgaccgcctggggagtacggccgcaaggttaaaactcaaatgaattgacgggggcccgcacaagcggtggagcatgtggttttatttcgatgctacgcgaacaaccttaccctactcttgacatccacggaattcggcagagatgccttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccacta

SEQ ID NO: 3578 - DNA, 1412 bp, Erwinia sp.
catgcagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtacagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacggagcagagatgccccggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccat

SEQ ID NO: 3579 - DNA, 1416 bp, Unknown
  Description of Unknown: bacterium polynucleotide
  Enterobacteriaceae
acatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccat

SEQ ID NO: 3580 - DNA, 1363 bp, Unknown
  Description of Unknown: bacterium polynucleotide
  Enterobacteriaceae
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacgggcgcaaggttaaaactcaatgcatttgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtag

SEQ ID NO: 3581 - DNA, 1364 bp, Unknown
  Description of Unknown: bacterium polynucleotide
  Enterobacteriaceae
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtaag

SEQ ID NO: 3582 - DNA, 1418 bp, Unknown
  Description of Unknown: bacterium polynucleotide
  Enterobacteriaceae
cacatgcagtcggacggtagcacagagagagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgctaccact

SEQ ID NO: 3583 - DNA, 1411 bp, Erwinia sp.
acatgcagtcggacggtagcacagagaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaacctccgggagggcgct

SEQ ID NO: 3584 - DNA, 1415 bp, Unknown
  Description of Unknown: bacterium polynucleotide
  Enterobacteriaceae
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggtattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacca

SEQ ID NO: 3585 - DNA, 1417 bp, Unknown
  Description of Unknown: bacterium polynucleotide
  Enterobacteriaceae
catgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccatc

SEQ ID NO: 3586 - DNA, 1412 bp, Unknown
  Description of Unknown: bacterium polynucleotide
  Enterobacteriaceae
acatgcaagtcggacggtagcacagaggaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgct

SEQ ID NO: 3587 - DNA, 1414 bp, Unknown
  Description of Unknown: bacterium polynucleotide
  Enterobacteriaceae
atgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggacgaataccggtggcgaaggcggccccctggacgaagactgacgctcacgtgcgaaagcgtggggagcaaacacgattacataccctggtagtccacgccgtaaacgatgtcgacttggacgttgttcccttgacgagtggcttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccata

SEQ ID NO: 3588 - DNA, 1409 bp, Ralstonia sp.
catgcagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattacgtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgatacca

SEQ ID NO: 3589 - DNA, 1404 bp, Ralstonia sp.
tgacagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaatcaggacacaggtgctgcatggctgtcgtcagctcgtgtcctgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgta

SEQ ID NO: 3590 - DNA, 1418 bp, Pseudomonas sp.; identical to SEQ ID NO: 3160

SEQ ID NO: 3591 - DNA, 1356 bp, Agrobacterium sp.; identical to SEQ ID NO: 3544

SEQ ID NO: 3592 - DNA, 1419 bp, Pantoea sp.; identical to SEQ ID NO: 3235

SEQ ID NO: 3593 - DNA, 1424 bp, Pantoea sp.; identical to SEQ ID NO: 3199

SEQ ID NO: 3594 - DNA, 793 bp, Escherichia sp.
  modified_base (34)..(34): a, c, t, g, unknown or other
agtcgaacggtaacaggaagcagcttgctgcttngctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgccctttgaggcgtg

SEQ ID NO: 3595 - DNA, 1420 bp, Pantoea sp.; identical to SEQ ID NO: 3182

SEQ ID NO: 3596 - DNA, 1424 bp, Enterobacter sp.; identical to SEQ ID NO: 3117

SEQ ID NO: 3597 - DNA, 602 bp, Acremonium zeae
ttgaggaagtaaaagtcgtaacaaggtctccgttggtgaaccagcggagggatcattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatatcaataaggcg

SEQ ID NO: 3598 - DNA, 1420 bp, Pantoea sp.; identical to SEQ ID NO: 3361

SEQ ID NO: 3599 - DNA, 1419 bp, Enterobacter sp.
cacatgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtcgagcatgtggtttaattcgatgcaacgcgaagtaccttacctggtcttgacatccacagaacttagcagagatggtatcgtgccttcgggtactgtgagacacgtgctgcatggctgtcgtcagctcgtgttgactaatgttgggttaagtcccgcaacgaccgcaaccgttatccttagtaccgtcgggttcggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccactta

SEQ ID NO: 3600 - DNA, 1422 bp, Enterobacter sp.; identical to SEQ ID NO: 3153

SEQ ID NO: 3601 - DNA, 1415 bp, Enterobacter sp.; identical to SEQ ID NO: 3209

SEQ ID NO: 3602 - DNA, 608 bp, Acremonium zeae
ttgaggaagtaaaagtcgtaacaaggtctccgttggtgaaccagcggagggaacattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatatcaataagccggaggaa

SEQ ID NO: 3603 - DNA, 894 bp, Saccharibacillus sp.
tcgagcggagccttagagaagcttgcttctctgatgcttagcggcggacgggtgagtaacacgtaggcaacctgcctttcagtttgggataacttccggaaacggatgctaataccgaatacatcatcctttggcatcagaggatgaggaaagacggcgcaagctgtcactgagagatgggcctgcggcgcattagctagttggtgaggtaatggctcaccaaggcgacgatgcgtagccgacctgagagggtgaacggccacactgggactgagacacggcccagactcctacgggaggcagcagtagggaatcttccacaatgggcgaaagcctgatggagcaatgccgcgtgagtgatgaaggttttcggatcgtaaagctctgttgccagggaagaacgtccgggtgagtaactgcacccggagtgacggtacctgagaagaaagccccggctaactacgtgccagcagccgcggtaatacgtagggggcaagcgttgtccggaattattgggcgtaaagcgcgtgcaggcggcttgttaagttgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttcggggtttcgataccctgggtgccgaagttcacgcattaagcactccgcctggggagtacggtcgcaagactgaaactcaaaggaattgacggggacccgcacaagcagtgg

SEQ ID NO: 3604 - DNA, 1333 bp, Sphingomonas sp.; identical to SEQ ID NO: 3250

SEQ ID NO: 3605 - DNA, 609 bp, Acremonium zeae
tcttggtcaatttagaggaagtaaaagtcgtaacaaggtctccgttggtgaaccagcggagggatcattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatatcaaaa

SEQ ID NO: 3606 - DNA, 1412 bp, Pseudomonas sp.; identical to SEQ ID NO: 3140

SEQ ID NO: 3607 - DNA, 878 bp, Pantoea sp.
  modified_base (759)..(759): a, c, t, g, unknown or other
acttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacggttcccgaaggcactaaggcatctctgccgaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggnattctacccccctctacaagactcaagcctgccagtttcaaatgcagttcccaggttaagcccggggatttcacatctgacttaacagaccgcctgcgtgcgctttacgcccagtaatt

SEQ ID NO: 3608 - DNA, 1389 bp, Enterobacter sp.
acatgcagtcgtacggtgagtcacacatagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcatgacatccagagaacattgcagagatgcattcgacgcatgcggtactctgacacagcagctgcatggctgtcgtcagctcctgttgtgaatagtagggttaagtcccgcaacgaagcgcaacccatttgctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagtaa

SEQ ID NO: 3609 - DNA, 1406 bp, Ralstonia sp.
accatgcagtcgacggcagcatgatcctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccgcttgtagtccacgccctaaacgatgtcaactagttgttggggattcatttccttagtaacgtagctaacgcgtgaagttgaccgcctgggggagtacggtcgcaagattaaaactcaaaggaattgacggggaccggcacaagcggtggatgatgtggattaatttgatgcaacgcgaaaaaccttacctacccttgacatgccactaacgaagcacagatgcattaggtgctcgaaagagaaagtggacacaggtgctgcatggctgtcgtcagctggtgtcgtgagatgttgggttaagtcccgcaacgagcgcaacccttgtctgtagttgctacgaaagggcactctagagagactgccggtgacaaaccggaggaaggtggggaggacgtcaagtcctcatggcccttatgggtagggggtcacacgtcatacaatggtgcgtacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcgctaaccgcaaggaggg

SEQ ID NO: 3610 - DNA, 611 bp, Alternaria epidermidis
tcttggttcaattagaggaagtaaaagtcgtaacaaggtctccgtaggtgaacctgcggagggatcattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaa

SEQ ID NO: 3611 - DNA, 566 bp, Epicoccum nigrum
tttagaggaagtaaaagtcgtaacaaggtttccgtaggtgaacctgcggaaggatcattacctagagtttgtggacttcggtctgctacctcttacccatgtcttttgagtaccttcgtttcctcggcgggtccgcccgccggttggacaacattcaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgttttgtctcgcctccgcgcgcagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaaaa

SEQ ID NO: 3612 - DNA, 576 bp, Epicoccum nigrum
tcttggtccaattagaggaagtaaaagtcgtaacaaggtttccgtaggtgaacctgcggaaggttcattacctagagtttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaaaag

SEQ ID NO: 3613 - DNA, 576 bp, Fusarium nigrum
tggtcatttagaggaagtaaaagtcgtaacaaggtctccgttggtgaaccagcgggaggttcattaccgagtttacaactcccaaacccctgtgaacataccttatgttgcctcggcggatcagcccgcgccccgtaaaaagggacggcccgccgcaggaaccctaaactctgtttttagtggaacttctgagtataaaaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggagctgcagtcctgctgcactccccaaatacattggcggtcacgtcgagcttccatagcgtagtaatttacacatcgttactggtaatcgtcgcggccacgccgttaaaccccaacttctgaatgttgacctcggatcaggtaggaatacccgctgaacttaagcatatcaataaggc

SEQ ID NO: 3614 - DNA, 543 bp, Cochliobolus sp.
ttggtgaccagcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcata

SEQ ID NO: 3615 - DNA, 539 bp, Embellisia sp.
  modified_base (19)..(19): a, c, t, g, unknown or other
tggtgaccagcggagggancattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatc

SEQ ID NO: 3616 - DNA, 539 bp, Podospora sp.
  modified_base (15)..(15): a, c, t, g, unknown or other
  modified_base (19)..(19): a, c, t, g, unknown or other
tggtgaccagcgganggancattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatc

SEQ ID NO: 3617 - DNA, 548 bp, Embellisia sp.
tctctccgttggtgaccagcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatc

SEQ ID NO: 3618 - DNA, 533 bp, Fusarium sp.
tctcgttggtgaccagcggagggatcattaccgagtttacaactcccaaacccctgtgaacatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatc

SEQ ID NO: 3619 - DNA, 1431 bp, Paenibacillus sp.
tacatgcagtcgagcggagttaataagaagcttgcttctttgagacttagcggcggacgggtgagtaacacgtaggcaacctgccctttagcctgggataactaccggaaacggtagctaataccggatactttctttttctgcatgggagaagaacgaaagacggagcaatctgtcactgaaggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttggagagtaactgctccgagagtgacggtacctgagaagaaagccccggctaactacgtgccagcagccgcggtaatacgtagggggcaagcgttgtcccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtgggagtatgtggtttaattcgaagcaacgcgaagaaccttaccaggtcttgacatctgaatgaccggtgcagagatgtacctttttcttcggaacattcaagacaggtggtgcatggttgtcgtcagctcgtgtcgtgagatgttgggttaagtcccgcaacgagcgcaacccttatgcttagttgccagcacgtaatgatgggcactctaagcagactgccggtgacaaaccggaggaaggtggggatgacgtcaaatcatcatgccccttatgacctgggctacacacgtactacaatggtcggtacaacgggaagcaaagccgcgaggtggagccaatccttaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaaccgcaaggagccagccgccgaa

SEQ ID NO: 3620 - DNA, 1425 bp, Stenotrophomonas sp.; identical to SEQ ID NO: 3176

SEQ ID NO: 3621 - DNA, 1423 bp, Stenotrophomonas sp.; identical to SEQ ID NO: 3205

SEQ ID NO: 3622 - DNA, 863 bp, Bacillus sp.
  modified_base (406)..(406): a, c, t, g, unknown or other
aaaggttacctcaccgacttcgggtgttacaaactctcgtggtgtgacgggcggtgtgtacaaggcccgggaacgtattcaccgcggcatgctgatccgcgattactagcgattccggcttcatgtaggcgagttgcagcctacaatccgaactgagaacggttttatcggattagctccccctcgcgggttggcaaccgtttgtaccgtccattgtagcacgtgtgtagcccaggtcataaggggcatgatgatttgacgtcatccccaccttcctccggtttatcaccggcagtctccttagagtgcccaactgaatgatggcaactaagaataagggttgcgctcgttgcgggacttaacccaacatctcacgacacgagctgacgacaaccatgcaccaccngtcaccgttgcccccgaaggggaaactatgtctccatagtggtcaccgggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactgaggggcggaaaccccccaacacttagcactcatcgtttacggcgtggactaccagggtatctaatcctgtttgctccccacgctttcgcgcctcagtgtcagttacagaccagacagtcgccttcgccactggtgttcctccaaatctctacgcatttcaccgctacacttggaattccactatcctcttctgcactcaagttccccagtttccaatgaccctccccggttgagccgggggctttcacatcagacttaag

SEQ ID NO: 3623 - DNA, 1433 bp, Bacillus sp.
cctatacatgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtgggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaag

SEQ ID NO: 3624 - DNA, 1442 bp, Bacillus sp.
tatacatgcagtcgagcgaacttttgggagcttgctcccaaaagttagcggcggacgggtgagtaacacgtgggcaacctgcctataagactgggataacttcgggaaaccggagctaataccggataacatatgagaccacatggtctcatattaaaagatggcttttagctatcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtaccgttcgaatagggcggtaccttgacggtacctaaccagaaagccacggctaactacgtgccagcagccgcggtaatacgtaggtggcaagcgttatccggaattatttgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaagcttaccaggtcttgacatccttattggcatttataagctcatagagctttcccccttcggggactaatgtgacagggtggagcatggttgtcgtcagctcgtgtcgagaaacatgttgggttaagtcccgcaacgaccgccaatcccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggttaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaagg

SEQ ID NO: 3625 - DNA, 1434 bp, Paenibacillus sp.
ctatactgcaagtcgagcggagttaataagaagcttgcttctttgagacttagcggcggacgggtgagtaacacgtaggcaacctgccctttagcctgggataactaccggaaacggtagctaataccggatactttctttttctgcatgggagaagaacgaaagacggagcaatctgtcactgaaggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttggagagtaactgctccgagagtgacggtacctgagaagaaagccccggctaactacgtgccagcagccgcggtaatacgtagggggcaagcgttgtccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtgggagtatgtggtttaattcgaagcaacgcgaagaaccttaccaggtcttgacatctgaatgaccggtgcagagatgtacctttttcttcggaacattcaagacaggtggtgcatggttgtcgtcagctcgtgtcgtgagatgttgggttaagtcccgcaacgagcgcaacccttatgcttagttgccagcacgtgatgatgggcactctaagcagactgccggtgacaaaccggaggaaggtggggatgacgtcaaatcatcatgccccttatgacctgggctacacacgtactacaatggtcggtacaacgggaagcaaagccgcgaggtggagccaatccttaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaaccgcaaggagccagccgccgaag

SEQ ID NO: 3626 - DNA, 1360 bp, Methylobacterium sp.; identical to SEQ ID NO: 3438

SEQ ID NO: 3627 - DNA, 1427 bp, Pantoea sp.
accatgcagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacaatccctagctggtctgagaggatgaccagccacactggaactgagacacggtccagactcctacgggaggcagcagtggggaatattgcacaatgggcgcaagcctgatgcagccatgccgcgtgtatgaaaaaagccttcgggttgtaaagtactttcaccggggaggaaggcgactggggttaataaccctgtcgattgacgttacccgcagaaaaaacaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaacgcggccccctggacaaagactgacgctcacgtgcgaaagcgtggggagcaaacaggattagataccctggaagtccacgccgtaaacgatgtccacttgcaggttgttcccttgaggagtggcttccggagctaacgcgttaagtcgaccgcctgcggagtaccgccgcaaggtaaaaactcatatgaattgacgggggcccgcacaagcggtggagcatgtggtttaattccatgcaacgcgaagaaccttacctactcttgacatccacaggaatttggcagagatgcctttcttggccttctcggaaccgtgagacaggtgctgcatggctgtcgctcaactcctggtcatcacaaaacttgggttaacagccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccactgtg

SEQ ID NO: 3628 - DNA, 1429 bp, Bacillus sp.; identical to SEQ ID NO: 3517

SEQ ID NO: 3629 - DNA, 1393 bp, Paenibacillus sp.; identical to SEQ ID NO: 3216

SEQ ID NO: 3630 - DNA, 1429 bp, Bacillus sp.; identical to SEQ ID NO: 3179

SEQ ID NO: 3631 - DNA, 1418 bp, Enterobacter sp.; identical to SEQ ID NO: 3135

SEQ ID NO: 3632 - DNA, 1391 bp, Curtobacterium sp.; identical to SEQ ID NO: 3218

SEQ ID NO: 3633 - DNA, 1362 bp, Sphingomonas sp.; identical to SEQ ID NO: 3143

SEQ ID NO: 3634 - DNA, 1423 bp, Paenibacillus sp.
gtcgagcggagttgataaggaagcttgcttcttcttgagacttagcggcggacgggtgagtaacacgtaggcaacctgccctttagcctgggataactaccggaaacggtagctaataccggatactttctttttctgcatgggagaagaacgaaagacggagcaatctgtcactgaaggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttggagagtaactgctctgagagtgacggtacctgagaagaaagccccggctaactacgtgccagcagccgcggtaatacgtagggggcaagcgttgtccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtaccttttcttcggaacattcaagacaggtgctgcatggatgtcgtcagctcgtgtcgtgagatgttgggttaagtcccgcaacgagcgcaacccttatgcttagttgccagcacatgatggtgggcactctaagcagactgccggtgacaaaccggaggaaggtggggatgacgtcaaatcatcatgccccttatgacctgggctacacacgtactacaatggtcggtacaacgggaagcaaagccgcgaggtggagccaatccttaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaaccgcaaggagccagccgcctaa

SEQ ID NO: 3635 - DNA, 1389 bp, Chryseobacterium sp.
cacatgcagctgagcggtagagatctttcgggatcttgagagcggcgtacgggtgcggaacacgtgtgcaacctgcctttatcagagggatagcctttcgaaaggaagattaatacctcataatatattgattcgcatggattgatattgaaaactccggtggatagagatgggcacgcgcaagattagatagttggtgaggtaacggctcaccaagtcgatgatctttagggggcctgagagggtgatcccccacactggtactgagacacggaccagactcctacgggaggcagcagtgaggaatattggacaatgggttagcgcctgatccagccatcccgcgtgaaggacgacggccctatgggttgtaaacttcttttgtacagggataaacctttctacgtgtagaaagctgaaggtactgtacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacaggattagataccctggtagtccacgccgtaaacgatgctaactcgtttttgggttttcggattcagagactaagcgaaagtgataagttagccacctggggagtacgttcgcaagaatgaaactcaaaggaattgacgggggcccgcacaagcggtggattatgtggtttaattcgatgatacgcgaggaaccttacgaaggcttaaatgggaattgacaggctcagaatagggtttttcttcggacaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggcaggtacagagggcagctacacagcgatgtgatgcgaatctcgaaagcctgtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcc

SEQ ID NO: 3636 - DNA, 1419 bp, Bacillus sp.; identical to SEQ ID NO: 3225

SEQ ID NO: 3637 - DNA, 1350 bp, Paenibacillus sp.; identical to SEQ ID NO: 3229

SEQ ID NO: 3638 - DNA, 1418 bp, Paenibacillus sp.; identical to SEQ ID NO: 3251

SEQ ID NO: 3639 - DNA, 1424 bp, Bacillus sp.; identical to SEQ ID NO: 3553

SEQ ID NO: 3640 - DNA, 549 bp, Acremonium zeae
gcggagggatcattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatat

SEQ ID NO: 3641 - DNA, 1401 bp, Burkholderia sp.; identical to SEQ ID NO: 3149

SEQ ID NO: 3642 - DNA, 549 bp, Acremonium zeae
cagcggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 3643 - DNA, 546 bp, Acremonium zeae
cggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 3644 - DNA, 537 bp, Acremonium zeae
cattaccagagtgccctaggctctccaacccattgtgaacatacctaacgttccctcggcgggctcagcgcgcggtgcctccgggctccgggcgtccgccggggacaaccaaaccctgatttcatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 3645 - DNA, 1421 bp, Bacillus sp.; identical to SEQ ID NO: 3230

SEQ ID NO: 3646 - DNA, 1416 bp, Enterobacter sp.; identical to SEQ ID NO: 3159

SEQ ID NO: 3647 - DNA, 547 bp, Acremonium strictum
gcggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 3648 - DNA, 1407 bp, Enterobacter sp.; identical to SEQ ID NO: 3425

SEQ ID NO: 3649 - DNA, 1415 bp, Enterobacter sp.; identical to SEQ ID NO: 3541

SEQ ID NO: 3650 - DNA, 556 bp, Acremonium strictum
ggtgaaccagcggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 3651 - DNA, 1373 bp, Pseudomonas sp.; identical to SEQ ID NO: 3267

SEQ ID NO: 3652 - DNA, 1410 bp, Pseudomonas sp.; identical to SEQ ID NO: 3269

SEQ ID NO: 3653 - DNA, 1334 bp, Pseudomonas sp.
tggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccttaacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagcttgccagttttggatgcagttcccaggttgagcccggggctttcacatccaacttaacaaaccacctacgcgcgctttacgcccagtaattccgattaacgcttgcaccctctgtattaccgcggctgctggcacagagttagccggtgcttattctgtcggtaacgtcaaaattgcagagtattaatctacaacccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaacaagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatccaggagcaagctccc

SEQ ID NO: 3654 - DNA, 542 bp, Alternaria alternata
ctgcggagggatcattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcata

SEQ ID NO: 3655 - DNA, 542 bp, Alternaria tenuissima; identical to SEQ ID NO: 3654

SEQ ID NO: 3656 - DNA, 1365 bp, Agrobacterium sp.; identical to SEQ ID NO: 3546

SEQ ID NO: 3657 - DNA, 506 bp, Phoma sp.
ctgcggaaggatcattacctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcata

SEQ ID NO: 3658 - DNA, 531 bp, Cladosporium tenuissimum
aggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcatcgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcata

SEQ ID NO: 3659 - DNA, 524 bp, Fusarium verticillioides
ggtgacctgcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggactcgcgagtcaaatcgcgttccccaaattgattggcggtcacgtcgagcttccatagcgtagtagtaaaaccctcgttactggtaatcgtcgcggccacgccgttaaaccccaacttctgaatgttgacctcggatcaggtaggaatacccgctgaacttaagcata

SEQ ID NO: 3660 - DNA, 548 bp, Acremonium zeae
  modified_base (471)..(471): a, c, t, g, unknown or other
  modified_base (520)..(520): a, c, t, g, unknown or other
gcggagggatcattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggntcgaccatgccgtaaaacccccaactttccaaggttgacctcggatcangtaggaatacccgctgaacttaagcata

SEQ ID NO: 3661 - DNA, 514 bp, Epicoccum sorghinum
acctgcggaggatcattacctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcatatcaataa

SEQ ID NO: 3662 - DNA, 547 bp, Alternaria tenuissima
ctgcggagggatcattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaat

SEQ ID NO: 3663 - DNA, 1399 bp, Stenotrophomonas sp.; identical to SEQ ID NO: 3396

SEQ ID NO: 3664 - DNA, 1335 bp, Methylobacterium sp.; identical to SEQ ID NO: 3441

SEQ ID NO: 3665 - DNA, 1355 bp, Escherichia sp.; identical to SEQ ID NO: 3558

SEQ ID NO: 3666 - DNA, 1391 bp, Chryseobacterium sp.
cacatgcagctgagcggtatttgtctttcgggacagagagagcggcgtacgggtgcggaacacgtgtgcaacctgcctttatctgggggatagcctttcgaaaggaagattaataccccataatataattgatggcatcattgattattgaaaactccggtggatagagatgggcacgcgcaagattagatagttggtgaggtaacggctcaccaagtcgatgatctttagggggcctgagagggtgatcccccacactggtactgagacacggaccagactcctacgggaggcagcagtgaggaatattggacaatgggttagcgcctgatccagccatcccgcgtgaaggacgacggccctatgggttgtaaacttcttttgtacagggataaacctaccctcgtgagggtagctgaaggtactgtacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacaggattagataccctggtagtccacgccgtaaacgatgctaactcgtttttgggtctttaagattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgaccggtttagaaatagaccttccttcgggcaattttcaaggtgctgcatggttgtcgtcagctcgtgccgtgaggtgttaggttaagtcctgcaacgagcgcaacccctgttactagttgctaccattcagttgaggactctagtaagactgcctacgcaagtagagaggaaggtggggatgacgtcaaatcatcacggcccttacgccttgggccacacacgtaatacaatggccggtacagagggcagctacctagcgataggatgcgaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcct

SEQ ID NO: 3667 - DNA, 1335 bp, Escherichia sp.; identical to SEQ ID NO: 3560

SEQ ID NO: 3668 - DNA, 762 bp, Methylobacterium sp.
gcctgcctccttgcggttggcgcagcgccgtcgggtaagaccaactcccatggtgtgacgggcggtgtgtacaaggcccgggaacgtattcaccgtggcatgctgatccacgattactagcgattccgccttcatgcacccgagttgcagagtgcaatccgaactgagacggcttttggggattcgctccaggtcgccccttcgctgcccattgtcaccgccattgtagcacgtgtgtagcccatcccgtaagggccatgaggacttgacgtcatccacaccttcctcgcggcttatcaccggcagtctccccagagtgcccaactgaatgatggcaactgaggacgtgggttgcgctcgttgcgggacttaacccaacatctcacgacacgagctgacgacagccatgcagcacctgtgtgcacgtccccgaagggaacaccggatctctccggctcgcatgccatgtcaagggatggtaaggttctgcgcgttgcttcgaattaaaccacatgctccaccgcttgtgcgggcccccgtcaattcctttgagttttaatcttgcgaccgtactccccaggcggaatgcgtaaagcgttagcggcgccactgaggtgcatgcaccccaacggctagcattcatcgtttacagcgtggactaccagggtatctaatcctgtttgctccccacgctttcgcgcctcagcgtcagaaccggaccagacagccgccttcgccactggtgttcttgcgaatatctac

SEQ ID NO: 3669 - DNA, 1406 bp, Acidovorax sp.; identical to SEQ ID NO: 3514

SEQ ID NO: 3670 - DNA, 1337 bp, Methylobacterium sp.; identical to SEQ ID NO: 3447

SEQ ID NO: 3671 - DNA, 1406 bp, Enterobacter sp.; identical to SEQ ID NO: 3542

SEQ ID NO: 3672 - DNA, 549 bp, Acremonium zeae
gcggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatat

SEQ ID NO: 3673 - DNA, 519 bp, Fusarium sp.
gcggagggatcattaccgagtttacaactcccaaacccctgtgaacatacctttatgttgcctcggcggatcagcccgcgccccgtaaaacgggacggcccgccgcaggaaaccctaaactctgtttttagtggaacttctgagtataaaaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggatctgtttgtcacaaaacagtcctcaaattgattggcggtcacgtcgagcttccatagcgtagtaatttacacatcgttactggtaatcgtcgcggccacgccgttaaaccccaacttctgaatgttgacctcggatcaggtaggaatacccgctgaacttaagcatat

SEQ ID NO: 3674 - DNA, 491 bp, Fusarium sp.
tgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatc

SEQ ID NO: 3675 - DNA, 516 bp, Fusarium sp.
gcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggactcgcgagtcaaatcgcgttccccaaattgattggcggtcacgtcgagcttccatagcgtagtagtaaaaccctcgttactggtaatcgtcgcggccacgccgttaaaccccaacttctgaatgttgacctcggatcaggtaggaatacccgctgaacttaagcata

SEQ ID NO: 3676 - DNA, 510 bp, Acremonium zeae
cccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcata

SEQ ID NO: 3677 - DNA, 536 bp, Cladosporium sp.
  modified_base (3)..(3): a, c, t, g, unknown or other
  modified_base (18)..(18): a, c, t, g, unknown or other
  modified_base (22)..(22): a, c, t, g, unknown or other
cgnaggtgacctgcggangganattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaa

SEQ ID NO: 3678 - DNA, 549 bp, Alternaria sp.
  modified_base (19)..(19): a, c, t, g, unknown or other
aggtgacctgcggaggganattacacaaatatgaaggcgggctggaacctcttggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatat

SEQ ID NO: 3679 - DNA, 551 bp, Alternaria sp.
  modified_base (19)..(19): a, c, t, g, unknown or other
aggtgacctgcggaggganattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatca

SEQ ID NO: 3680 - DNA, 530 bp, Cladosporium sp.
  modified_base (19)..(19): a, c, t, g, unknown or other
aggtgacctgcggaggganattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatat

SEQ ID NO: 3681 - DNA, 554 bp, Alternaria sp.
  modified_base (4)..(4): a, c, t, g, unknown or other
  modified_base (19)..(19): a, c, t, g, unknown or other
tcgnaggtgacctgcgganggatcattacacaaatatgaaggcgggctggaacctcttggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatat

SEQ ID NO: 3682 - DNA, 575 bp, Alternaria infectoria
  modified_base (18)..(18): a, c, t, g, unknown or other
ggtgacctgcggaggganattacacaataaccaggcgggctggacaccccccgctgggcactgcttcacggcgtgcgcggcggggccggccctgctgaattattcacccgtgtcttttgcgtacttcttgtttcctgggtgggctcgcccgccctcaggaccaaccacaaaccttttgcaatagcaatcagcgtcagtaacaacgtaattaattacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtcttttgtctccagttcgctggagactcgccttaaagtcattggcagccggcctactggtttcggagcgcagcacaagtcgcgctctttgccagccaaggtcagcgtccagcaagcctttttttcaacctttgacctcggatcaggtagggatacccgctgaacttaagcat

SEQ ID NO: 3683 - DNA, 1038 bp, Alternaria sp.
acctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttacagttgctcatccgggtttctacccggtgcactcttctgtaggcaggccagcatcagtttgggcggtaggataaaggtctctgtcacgtacctcctttcggggaggccttataggggagacgacatactaccagc

SEQ ID NO: 3684 - DNA, 1033 bp, Nigrospora oryzae
tacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccctaatgcgattggcggagtggcagtagtcctctgagcgtagtaattctttatctcgcttttgttaggtgctgcccccccggccgttaaacccccaattttttctggttgacctcggatcaggtaggaatacccgctgaacttaagcatatcaataagcggaggaaaagaaaccaacagggattcccctagtaacggcgagtgaagcgggaacagctcaaatttgaaatctggccctcgggtccgagttgtaatttgtagaggatgcttttggtgcggtgccttccgagttccctggaacgggacgccttagagggtgagagccccgtacggttggacgcctagcctctgtaaagctccttcgacgagtcgagtagtttgggaatgctgctctaaatgggaggtatatttcttctaaagctaaatactggccagagaccgatagcgcacaagtagagtgatcgaaagatgaaaagcactttgaaaagagggttaaatagcacgtgaaattgttgaaagggaagcgtttatcaccagactttttctggggggatcatccggtgttctcaccggtgcacttcccccagttgaggccagcatcggttttcggagggggataaaagcttcgggaatgtggctccctcgggagtgttatagcccgttgcataatac

SEQ ID NO: 3685 - DNA, 1001 bp, Nigrospora oryzae
acttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccctaatgcgattggcggagtggcagtagtcctctgagcgtagtaattctttatctcgcttttgttaggtgctgcccccccggccgttaaacccccaattttttctggttgacctcggatcaggtaggaatacccgctgaacttaagcatatcaataagcggaggaaaagaaaccaacagggattcccctagtaacggcgagtgaagcgggaacagctcaaatttgaaatctggccctcgggtccgagttgtaatttgtagaggatgcttttggtgcggtgccttccgagttccctggaacgggacgccttagagggtgagagccccgtacggttggacgcctagcctctgtaaagctccttcgacgagtcgagtagtttgggaatgctgctctaaatgggaggtatatttcttctaaagctaaatactggccagagaccgatagcgcacaagtagagtgatcgaaagatgaaaagcactttgaaaagagggttaaatagcacgtgaaattgttgaaagggaagcgtttatcaccagactttttctggggggatcatccggtgttctcaccggtgcacttcccccagttgaggccagcatcggttttcggagggggataaaagcttcgggaatgtggctccctcgggagtgttatagcccgttgcataatac

SEQ ID NO: 3686 - DNA, 994 bp, Fusarium sp.
acatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaaggcttcgggaatgtggctctctccggggagtgttatagcccgttgcgtaatac

SEQ ID NO: 3687 - DNA, 994 bp, Fusarium sp.; identical to SEQ ID NO: 3686

SEQ ID NO: 3688 - DNA, 1005 bp, Fusarium sp.
actaccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatacttttgatgcggtgccttccgagttccctggaacgggacgccatagagggtgagagccccgtctggttggatgccaaatctctgtaaagttccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttccccgggggataaagacttcgggaatgtggctctcttcggggagtgttatagcccgttgtgtaatac

SEQ ID NO: 3689 - DNA, 994 bp, Fusarium sp.; identical to SEQ ID NO: 3686

SEQ ID NO: 3690 - DNA, 994 bp, Fusarium sp.; identical to SEQ ID NO: 3686

SEQ ID NO: 3691 - DNA, 1005 bp, Fusarium udum
acataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcctcacggcaagccggccccgaaatacagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatacttttgatgcggtgccttccgagttccctggaacgggacgccatagagggtgagagccccgtctggttggatgccaaatctctgtaaagttccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaagacttcgggaatgtggctctcttcggggagtgttatagcccgttgtgtaatac

SEQ ID NO: 3692 - DNA, 992 bp, Fusarium sp.
aatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaaggcttcgggaatgtggctctctccggggagtgttatagcccgttgcgtatac

SEQ ID NO: 3693 - DNA, 994 bp, Fusarium sp.
acatacctatacgttgcctcggcggatcagcccgcgccccgtaaaacgggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggataatcatctggggttctctccagtgcacttttccagtccaggccagcatcagttttcgccgggggataaaggcttcgggaatgtggctctctccggggagtgttatagcccgttgcgtaatac

SEQ ID NO: 3694 - DNA, 1014 bp, Cladosporium sp.
agtgaccccggtctaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcgacgtccgagttgtaatttgtagaggatgcttctgagtaaccaccgacctaagttccttggaacaggacgtcatagagggtgagaatcccgtatgcggtcggaaaggtgctctatacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttaaaagggaagggattgcaaccagacttgctcgcggtgttccgccggtcttctgaccggtctactcgccgcgttgcaggccagcatcgtctggtgccgctggataagacttgaggaatgtagctccctcgggagtgttatagc

SEQ ID NO: 3695 - DNA, 994 bp, Fusarium sp.; identical to SEQ ID NO: 3686

SEQ ID NO: 3696 - DNA, 994 bp, Fusarium sp.; identical to SEQ ID NO: 3686

SEQ ID NO: 3697 - DNA, 1064 bp, Alternaria sp.
attacacaaatatgaaggcgggctggaacctctcggggttcagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttacagttgctcatccgggtttctacccggtgcactcttctgtaggcaggccagcatcagtttgggcggtaggataaaggtctctgtcacgtacctcctttcggggaggccttataggggagacgacatactaccagc

SEQ ID NO: 3698 - DNA, 1046 bp, Alternaria sp.
atatgaaggcgggctggaacctctcggggttacagccttgctgaattattcacccttgtcttttgcgtacttcttgtttccttggtgagttcgcccaccactaggacaaacataaaccttttgtaattgcaatcagcgtcagtaacaaattaataattacaactttcagagcaacggatctcttggattcatggcatcgatgaagaacgcagtcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgctttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttacagttgctcttctcgggtttttatccggtgcactcttctgtaggcaggccagcatcagtttgggcggtaggataaaggtctttgtcaggtacctcctttcggggaggcgttataggggag

SEQ ID NO: 3699 - DNA, 994 bp, Fusarium sp.; identical to SEQ ID NO: 3686

SEQ ID NO: 3700 - DNA, 1032 bp, Fusarium sp.
ttaccgagtttaaactcccaaacccctgtgaacatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaaggcttcgggaatgtggctctctccggggagtgttatagcccgttgcgtaataccctggcg

SEQ ID NO: 3701 - protein, 511 aa, Serratia proteamaculans
  arabinose ABC transporter ATP-binding protein; Serratia; proteamaculans 568
MTAALPYLAFKGIGKTFPGVKALDDISFSCQAGQIHALMGENGAGKSTLLKILSGNYAPTQGEIQLQGRSVQFANTTDALNAGVAIIYQELHLVPEMTVAENIYLGQLPTKRGLVDRKLLRYESRLQLQHLGLDIDPDTPLKYLSIGQWQMVEIAKALARNAKVIAFDEPTSSLSAREIEQLFRVIRELRAEGRVILYVSHRMEEIFALSDAITVFKDGRYVRTFDDMRQVDNAQLVQAMVGRDLGDVYGYQPRELGPVRLELKGLKAPGVKTAIDLSVRAGEIVGLFGLVGAGRSELMKGVFGATRVSAGQLMLDGQAIAIRSPIDAIRAGIMLCPEDRKADGIIPVHSVRDNINISARRNSLRAGCLINKGWEASNADHHIRALNIKTPGPEQLIMNLSGGNQQKAILGRWLSEEMKVILLDEPTRGIDVGAKHEIYHVIYQLAQRGIAVLFASSDLPEVLGLADRILVMREGALSGELRHDEASEEKALSLAMLRTPDIAPDAAAAVA

SEQ ID NO: 3702 - protein, 504 aa, Enterobacter sp.
  arabinose ABC transporter ATP-binding protein; Enterobacter; sp 638
MQQSDPYLSFRGIGKTFPGVNALTDISFDCYPGQVHALMGENGAGKSTLLKILSGNYSPSTGTIAIRGEEMAFADTTAALNAGVAIIYQELHLVPEMTVAENIYLGQLPHKGGFVNRSLLNYEAGLQLKHLGLDIDPQIPLKYLSIGQWQMVEIAKALARNAKIIAFDEPTSSLSAREIENLFRVIRELRKEGRIILYVSHRMEEIFALSDAITVFKDGRYVRTFTDMQQVNHDQLVQAMVGRELGDIYHWQPRPYGTERLRLENVKAPGVRTPISLTVRSGEIVGLFGLVGAGRSELMKGLFGGTRITEGQVYIDGQPVNIQKPAHAIRAGMMLCPEDRKADGIIPVHSVRDNINISARRKFIRAGCLINDGWESSNADHHIRSLNIKTPGAEQLIMNLSGGNQQKAILGRWLSEEMKVILLDEPTRGIDVGAKHEIYNVIYELAKRGVAVLFASSDLPEVLGVADRIIVMREGDIAGELHHEQANEQQALSLAMPKVSQAVA

SEQ ID NO: 3703 - protein, 504 aa, Klebsiella pneumoniae
  arabinose ABC transporter ATP-binding protein; Klebsiella; pneumoniae 342
MQQSTPYLSFRGITMTFPGVKALSDISFDCYPGQIHALMGENGAGKSTLLKILSGNYIPTAGHLQIGGQQMAFSNTMEALNAGVAIIYQELHLIPEMTVAENIYLGQLPHRGGIVNRSLLNYEARLQLEHLGLDIDPETPLKYLSIGQWQMVEIAKALARNAKIIAFDEPTSSLSAREIDNLFRVIRELRQEGRVIIYVSHRMEEIFALSDAITVFKDGRYVCTFDDMPSVSHDALVQAMVGRNLGDIYGWKPRPYGEERLRLEEVKAPGVRTPVSLSVRSGEIVGLFGLVGAGRSELMKGLFGGTRITGGQVYIDGQPVDIRKPAQAIQAGMMLCPEDRKAEGIIPVHSVRDNINISARRKHIHAGCLINNAWEADNADQHIQSLNIKTPGPEQLIMNLSGGNQQKAILGRWLSEEMKVILLDEPTRGIDVGAKHEIYNVIYGLAASGVAVVFASSDLPEVLGVADRIVVMREGQIAGELLHEEANEQQALSLAMPKVSQAVA

SEQ ID NO: 3704 - protein, 504 aa, Klebsiella pneumoniae; identical to SEQ ID NO: 3703
  arabinose ABC transporter ATP-binding protein; Klebsiella; pneumoniae 342

SEQ ID NO: 3705 - protein, 506 aa, Pantoea stewartii
  arabinose ABC transporter ATP-binding protein; Pantoea; stewartii subsp stewartii DC283
MNTDSAFLSFHGISKTFPGVKALQDISFECHGGQVHALMGENGAGKSTLLKILSGSYLPSGGEIRIKGKPMNFQHTTDALDAGVAIIYQELHLVPEMSVAENIYLGQLPHKHGLVNRKLLRYEAGLQLKNLGMDIDPDMPLKYLSLGQWQMVEIAKALARNARIIAFDEPTSSLSAREIDNLFRVIRQLRAEGRVVLYVSHRMEEIFALSDAITVFKDGRYVRTFTDMANTHHDDLVQAMVGRNLGDIYGYAPREKGPVRLALQDVEAKGVRAPISLNVHAGEIVGLFGLVGAGRTELLKGLFGATRLRGGRILLDGEPLNVTAPIDAIRAGVMLCPEDRKAEGIIPVHSVRDNINISARRHNLTAGCLIKNGWEVKNADSHIRSLKIKTPSADQLIMNLSGGNQQKAILGRWLSEEIKVILLDEPTRGIDVGAKHEIYNLIYQLANNGIAVLFASSDLPEVMGLADRIIVMREGAVAGELLHGEATEQLTLSLAMPKTTHAAAVA

SEQ ID NO: 3706 - protein, 515 aa, Burkholderia phytofirmans
  arabinose ABC transporter ATP-binding protein; Burkholderia; phytofirmans PsJN
MTSSHTESHAAQAAPSPALASTEPYLRLDGITVRFPGVLALDQVSLEVRRGEVHGLMGENGAGKSTLLKVLSGVNQPAAGTLSLDGVEQQFITTKAAIAAGVAIIYQELHLVPELTVAENLMLGALPNRFGILDEKALVARAVRELERLGEKIDPSQQVKNLSIGQRQMIEIGKALMRDARVIAFDEPTSSLSSRETTQLFRIIRALKAEGRAIIYVTHRMDEVYELCDRVTVFRDGRRIDTFEAGEGLDRDRLISCMVGRSIADVYGYRSRDLGDVQLDVKEMMGRGLREPASFTARKGEIVGFFGLVGAGRSELMKLIYGAVKPDAGEIALKGKRVRFATPRDAVRAGVALCPEDRKQEGIVSIASVSDNLNISCRRHFSRFNVLNGRKEAQTAKEFIGKLAIKTRNGDTPIGTLSGGNQQKVILSRWLAEDIDVFLMDEPTRGIDVGARSEIYGLLYGLAEAGRTVIVVSSDLAEVIGVADRVIVMKEGRIVGDLPKAQATPDALIKLALPR

SEQ ID NO: 3707 - protein, 515 aa, Burkholderia phytofirmans; identical to SEQ ID NO: 3706
  arabinose ABC transporter ATP-binding protein; Burkholderia; phytofirmans PsJN

SEQ ID NO: 3708 - protein, 512 aa, Burkholderia phytofirmans
  arabinose ABC transporter ATP-binding protein; Burkholderia; phytofirmans PsJN
MSATLRFDNIGKVFPGVRALDGVSFDVNVGQVHGLMGENGAGKSTLLKILGGEYQPDSGRVMIDGNEVRFTSAASSIAAGIAVIHQELQYVPDLTVAENLLLGQLPNSLGWVNKREAKRFVRERLEAMGVALDPNAKLRKLSIAQRQMVEICKALLRNARVIALDEPTSSLSHRETEVLFKLVRDLRADNRAMIYISHRMDEIYELCDACTIFRDGRKIASHPTLEGVTRDTIVSEMVGREISDIYNYSARPLGEVRFAAKGIEGHALAQPASFEVRRGEIVGFFGLVGAGRSELMHLVYGADHKKGGELLLDGKPIKVRSAGEAIRHGIVLCPEDRKEEGIVAMATVSENINISCRRHYLRVGMFLDRKKEAETADRFIKLLKIKTPSRRQKIRFLSGGNQQKAILSRWLAEPDLKVVILDEPTRGIDVGAKHEIYNVIYQLAERGCAIVMISSELPEVLGVSDRIVVMRQGRISGELTRKDATEQSVLSLALPQSSTALPGTQAAAQQAA

SEQ ID NO: 3709 - protein, 504 aa, Klebsiella pneumoniae; identical to SEQ ID NO: 3703
  arabinose ABC transporter ATP-binding protein; Klebsiella; pneumoniae 342

SEQ ID NO: 3710 - protein, 511 aa, Serratia proteamaculans; identical to SEQ ID NO: 3701
  arabinose ABC transporter ATP-binding protein; Serratia; proteamaculans 568

SEQ ID NO: 3711 - protein, 504 aa, Enterobacter sp.; identical to SEQ ID NO: 3702
  arabinose ABC transporter ATP-binding protein; Enterobacter; sp 638

SEQ ID NO: 3712 - protein, 506 aa, Pantoea stewartii; identical to SEQ ID NO: 3705
  arabinose ABC transporter ATP-binding protein; Pantoea; stewartii subsp stewartii DC283

SEQ ID NO: 3713 - protein, 512 aa, Burkholderia phytofirmans; identical to SEQ ID NO: 3708
  arabinose ABC transporter ATP-binding protein; Burkholderia; phytofirmans PsJN

SEQ ID NO: 3714 - protein, 515 aa, Burkholderia phytofirmans; identical to SEQ ID NO: 3706
  arabinose ABC transporter ATP-binding protein; Burkholderia; phytofirmans PsJN

SEQ ID NO: 3715 - protein, 504 aa, Enterobacter sp.; identical to SEQ ID NO: 3702
  arabinose ABC transporter ATP-binding protein; Enterobacter; sp 638

SEQ ID NO: 3716 - protein, 504 aa, Klebsiella pneumoniae; identical to SEQ ID NO: 3703
  arabinose ABC transporter ATP-binding protein; Klebsiella; pneumoniae 342

SEQ ID NO: 3717 - protein, 511 aa, Serratia proteamaculans; identical to SEQ ID NO: 3701
  arabinose ABC transporter ATP-binding protein; Serratia; proteamaculans 568

SEQ ID NO: 3718 - protein, 506 aa, Pantoea stewartii; identical to SEQ ID NO: 3705
  arabinose ABC transporter ATP-binding protein; Pantoea; stewartii subsp stewartii DC283

SEQ ID NO: 3719 - protein, 512 aa, Burkholderia phytofirmans; identical to SEQ ID NO: 3708
  arabinose ABC transporter ATP-binding protein; Burkholderia; phytofirmans PsJN

SEQ ID NO: 3720 - protein, 515 aa, Burkholderia phytofirmans; identical to SEQ ID NO: 3706
  arabinose ABC transporter ATP-binding protein; Burkholderia; phytofirmans PsJN

SEQ ID NO: 3721 - protein, 321 aa, Pseudomonas savastanoi
  arabinose ABC transporter permease; Pseudomonas; savastanoi pv savastanoi
MSTESSLQAPRQGMNLRRFADDWVMLLAAVGIFLLCAVFIDNFMSPLNMRGLGLAISTVGIAACTMLFCLASGHFDLSVGSVLACSGVIAGIVIRDTDSVFLGVSAALALGLVVGLINGIVIAKLRINALITTLATMQIVRGLAYIFSNGKAVGVSNEDFFIFGNGQIYGVPVPILITIACFIFFGWLLNYTTYGRNTMAIGGNQEAALLAGVHVDRTKIIIFAVHGLVGALAGVVLASRMTSGQPMIGQGFELTIISACVLGGVSLSGGIGMIRHVIAGVLILAIIENAMNLKNIDTFYQYVIRGTILLLAVIIDRLKRR

SEQ ID NO: 3722 - protein, 326 aa, Klebsiella pneumoniae
  arabinose ABC transporter permease; Klebsiella; pneumoniae 342
MSSVTTSGATRSAFSFARIWDQFGMLVVFAVLFIGCVIFVPNFASFVNMKGLGLAISMSGMVACGMLFCLASGDFDLSVASVIACAGVTTAVVINLSESLWLGIAAGLLLGAVSGLVNGFVIARLKINALITTLATMQIVRGLAYIISDGKAVGIEDERFFTLGYANWFGLPAPIWLTVACLVVFGLLLNKTTFGRNTLAIGGNEEAARLAGVPVVRTKIIIFVLSGLVSAAAGIILASRMTSGQPMTSIGYELIVISACVLGGVSLKGGIGKISYVVAGILILGTVENAMNLLNISPFSQYVVRGVILLAAVIFDRYKQKAKRAA

SEQ ID NO: 3723 - protein, 327 aa, Pantoea sp.
  arabinose ABC transporter permease; Pantoea; sp 9140
MASSTTSNTPQPASRGGLQLGRIWDNFGMLVVFALLFIVCAIFVPNFGSFINMKGLGLAMSMSGMVACGMLFCLASGDFDLSVASVIACAGVVTAVVINMTESLWIGVAAGLVLGMITGFINGFVIARLKINALITTLATMQIVRGLAYIFSDGKAVGIEDERFFELGFANWLGVPAPIWLTLATMLIFGFLLNKTTFGRNTLAIGGNEEAARLAGVPVVRTRIIIFILSGLVSAAAGIILASRMTSGQPMTSIGYELVVISACVLGGVSLKGGIGKISYVVAGVLILGTVENAMNLLNISPFSQYVVRGLILLAAVIFDRYKQKKA

SEQ ID NO: 3724 - protein, 327 aa, Serratia proteamaculans
  arabinose ABC transporter permease; Serratia; proteamaculans 568
MSTITTHSVKKRNGLGLARIWDSYGMLVVFAVLFLACALFVPNFGSFINMKGLGLAISMSGMVACGMLFCLASGDFDLSVASVIACAGVTTAVVINMTESLWIGVAAGLLLGMVSGLINGFVIARLKINALITTLATMQIFRGLAYIISDGKAVGIEDERFFALGYANWLGLPAPIWITVACLILFGFLLNKTTFGRNTLAIGGNEEAARLAGVPVVRTKIVIFMLSGLVSAAAGIILASRMTSGQPMTSIGYELIVISACVLGGVSLKGGIGKISYVIAGILILGTVENAMNLLNISPFSQYVVRGVILLAAVIFDRYKQQAKRSV

SEQ ID NO: 3725 - protein, 328 aa, Pantoea stewartii
  arabinose ABC transporter permease; Pantoea; stewartii subsp stewartii DC283
MTSSTTSNTPPAAPRRGVHFGRVWDNFGMLVVFALLFIACAIFVPNFGSFINMKGLGLAMSMSGMVACGMLFCLASGDFDLSVASVIACAGVVTAVVINMSESLWLGVAAGLLLGVITGFINGFVIARLKINALITTLATMQIVRGLAYIFSDGKAVGIEDERFFVLGFANWLGVPAPIWITLGTMVIFAFLLNKTTFGRNTLAIGGNEEAARLAGVPVVRTRIIIFILSGLVSAAAGIILASRMTSGQPMTSIGYELVVISACVLGGVSLKGGIGKISYVIAGVLILGTVENAMNLLNISPFSQYVVRGLILLAAVIFDRYKQKNKV

SEQ ID NO: 3726 - protein, 335 aa, Ralstonia solanacearum
  arabinose ABC transporter permease; Ralstonia; solanacearum GMI1000
MSQSQPLQRADGFAASARSAMNNTRLLRRLDDFSLPLIFAILFAALSLSVEYFFSWQNMVGLALSVSQIGMVACTMMFCLASRDFDLSIGSTVAFAGVLCATVINATGSIALGIGASLLAGAVIGGINGFVIARLKINALITTLATMEIVRGLAFIASHGQAVGVSEMAFFDLGNTIVLGVPTPVWVAALCFVAFGVLLNKTVYGRNTLAIGGNPEAARLAGVNVNLTRIVIFLVQGVIAALAGVILAARITSGQPNAAQGFELNVISACVLGGVSLMGGRASISGVLVGVLIMGTVQNAMNLLNIDAFYQYLVRGGILLAAVLVDQIKHRGGRD

SEQ ID NO: 3727 - protein, 326 aa, Enterobacter sp.
  arabinose ABC transporter permease; Enterobacter; sp 638
MSSVTTSQTQKSAFSLGRIWDQYGMLVVFAVLFIGCAIFVPNFASFINMKGLGLAISMSGMVACGMLFCLASGDFDLSVASVIACAGVTTAVVINMTESLWIGVFAGLLLGMLSGLVNGFVIARLKINALITTLATMQIVRGLAYIISDGKAVGIEDERFFALGYANWLGLPAPIWLTVGCLIIFGFLLNRTTFGRNTLAIGGNEEAARLAGVPVVRTKIIIFVLSGLVSAAAGIILASRMTSGQPMTSIGYELIVISACVLGGVSLKGGIGKISYVVAGILILGTVENAMNLLNISPFSQYVVRGLILLAAVIFDRYKQKAKRTV

SEQ ID NO: 3728 - protein, 334 aa, Burkholderia phytofirmans
  arabinose ABC transporter permease; Burkholderia; phytofirmans PsJN
MQTPSTDSSTPAVASAGLSARAARTWDLINKSGIVMVFVILFAALSFTVPDFLSSRNIQGLLLSVTLIGSISVTMMFVLALGEVDLSVASIVAFAGVVASTLITATHSVILGVAAGVLAGGAVGLVNGVLVARYKINSLIVTLAMMEVVRGLAYITSNGDAVMISEERFFDLGGGAFLGISYPIWSNIIGFVLFGFLLKKTVFGKNVLAVGGNSEAALLAGLPVTRIKITVFVLQGLVTGFAGVMLASRMSLGDPKTSVGLELGVISACVLGGVSLTGGVATISGVLVGVLIMGSVQDAMSLLNVPTFYQYLIRGGILLLAVLFDQFRRSKRVH

SEQ ID NO: 3729 - protein, 338 aa, Burkholderia phytofirmans
  arabinose ABC transporter permease; Burkholderia; phytofirmans PsJN
MQARENLAQQAAKGAAEALIPQSNDKAKWWQQITEYSLIVIFVVMFATMSLTVDHFFSIENMLGLALSISQIGMVSCTMMFCLASRDFDLSVGSTVAFAGVLCAMVLNATGNTFIAIVAAVAAGGVIGFVNGAVIAYLRINALITTLATMEIVRGLGFIVSHGQAVGVSSDTFIALGGLSFFGVSLPIWVTLLCFIVFGVMLNQTVYGRNTLAIGGNPEASRLAGINVERTRVYIFLIQGAVTALAGVILASRITSGQPNAAQGFELNVISACVLGGVSLLGGRATISGVVIGVLIMGTVENVMNLMNIDAFYQYLVRGAILLAAVLLDQLKNRGSRD

SEQ ID NO: 3730 - protein, 329 aa, Enterobacter sp.
  arabinose ABC transporter substrate-binding protein; Enterobacter; sp 638
MHKFTKTLAAIGLAAVMSQSAMAENLKLGFLVKQPEEPWFQTEWKFADKAGKDLGFEVIKIAVPDGEKTLNAIDSLAASGAKGFVICTPDPKLGSAIVAKAKGYGMKVIAVDDQFVTAKGKPMDTVPLVMMAATKIGERQGQELYKEMQKRGWDVKETAVMAITADELDTARRRTTGSMDALKAAGFPVAQIYKVPTKSNDIPGAFDAANSMLVQHPEVKHWLVLGMNDNTVLGGVRATEGQGFKAADVIGVGINGVDAVSELSKAQATGFYGSLLPSPDVHGYKSSEMLYNWVTKDAEPPKFTEVTDVVLITRDNFKEELAKKGLGGK

SEQ ID NO: 3731 - protein, 327 aa, Pantoea stewartii
  arabinose ABC transporter substrate-binding protein; Pantoea; stewartii subsp stewartii DC283
MHKFTKALAAIGLAAVMSQSAIAETMKLGFLVKQPEEPWFQTEWKFADKAGKDLGFEVIKIAVPDGEKTLNAIDSLAANGAKGFVICTPDPKLGSAIMAKARGYGLKVIAVDDQFVNAKGKPMDSVPLVMMAATKIGERQGQELYKEMQKRGWDVKDTAVMAITANELDTARRRTGGSMDALKAAGFPEKQIYQVPTKSNDIPGAFDAGNSLLVQHPEVKHWLIVGMNDNTVLGGVRATEGQGFKAADVIGIGINGVDAVSELSKANATGFYGSLLPSPDIHGYKSSQMLYNWVSKGQEPPKFTEVTDVVLITRDNFKTELAKKGLM

SEQ ID NO: 3732 - protein, 326 aa, Klebsiella pneumoniae
  arabinose ABC transporter substrate-binding protein; Klebsiella; pneumoniae 342
MHKFTKALAAIGLAAVMSQSAMAENLKLGFLVKQPEEPWFQTEWKFADKAGKDLGFDVIKIAVPDGEKTLNAIDSLAASGAKGFVICTPDPKLGSAIVAKARGYDMKVITVDDQFVNAKGKPMESVPLVMMAASEIGARQGQELYKEMQKRGWDVKDTAVMAITADELDTARRRTTGSIDALKAAGFPDAQIYRVPTKSNDIPGAFDAGNSMLVQHPQVKHWLIVGMNDNTVLGGVRATEGQGFKAPDVIGIGINGVDAVNELSKAQPTGFYGSLLPSPDIHGYKTSEMLYNWVTKGVEPPKFTAVTDVVLITRDNFKEELAKKGL

SEQ ID NO: 3733 - protein, 327 aa, Pantoea sp.
  arabinose ABC transporter substrate-binding protein; Pantoea; sp 9140
MHKFTKAFAAIGLAAVMSQSAIAETMKLGFLVKQPEEPWFQTEWKFADKAGKDLGFDVIKIAVPDGEKTLNAIDSLAANGAKGFVICTPDPKLGSAIMAKARGYGLKVIAVDDQFVTAKGKPMDTVPLVMMAATKIGERQGQELYKEMQKRGWDVKTTGVMAITANELDTARRRTGGSMDAIKAAGFPAAQIYQVPTKSNDIPGAFDAGNSLLVQHPEVKHWLVVGMNDNTVLGGVRATEGQGFKAADVIGIGINGVDAISELSKDKATGFYGSLLPSPDIHGYKSSQMLYNWVSKGEEPPKFTEVTDVVLITRDNFKTELAKKGLM

SEQ ID NO: 3734 - protein, 327 aa, Serratia proteamaculans
  arabinose ABC transporter substrate-binding protein; Serratia; proteamaculans 568
MHKFTKALVTLSLAAVMSHSAIAETMKLGFLVKQPEEPWFQTEWKFADKAGKDLGFEVIKIAVPDGEKTLNAIDSLAASGAKGFVICTPDPKLGSAIVAKARSYNLKVIAVDDQFVTAKGKPMDSVPLVMMAATKIGERQGQELWKEQNKRGWKLADTAVMAITADELDTARRRTGGSIDALKAAGFPEKQIYRVPTKSNDIPGAFDAANSMLVQHPEVKNWLIVGMNDNTVLGGVRATEGQGFKAPNVIGIGINGVDAVSELSKAQATGFYGSLLPSPDIHGYKSIQMLHDWVEKGVEPQKFTEVTDVVLITRDNFKTELQKKGLM

SEQ ID NO: 3735 - protein, 332 aa, Burkholderia phytofirmans
  arabinose ABC transporter substrate-binding protein; Burkholderia; phytofirmans PsJN
MKRRIFLTLAAAATGVLFNAPVAQAADPVKIGFLVKQPEEPWFQDEWKFAEIAAKEKGFTLVKIGAPSGEKVMSAIDNLSAQKAQGFVICTPDVKLGPGIVAKAKADGLKMMTVDDRLVDGAGKPIASVPHMGISAYNIGKQVGDGLAAEIKKRGWDMKDVGAIDVTYEQLPTAHDRTSGATDALIAAGFPKANIVMAPQAKTDTENAFNAANIALTKNPQFKHWVAYALNDEGVLGAVRAAEGRGFKADNMIGIGIGGSDSALNEFKKPSPTGFYGTVIISPKRHGEETSTLMYDWITQGKAPPPLTLTTGMLATRDNVADVRQKMGLAAN

SEQ ID NO: 3736 - protein, 331 aa, Burkholderia gladioli
  arabinose ABC transporter substrate-binding protein; Burkholderia; gladioli UCD-UG CHAPALOTE
MKRRTFVTLAAAAAVLAGAPFAQAADPVKIGFLVKQPEEPWFQDEWKFAEMAAKAKGFTLVKIGAPSGEKVMSAIDNLSAQQAQGFIICTPDVKLGPGIVAKAKSHNLKMMTVDDRLVDGSGKPIESVPHMGISAYNIGKQVGDGLAAEIKKRGWNMAEVGAIDITYEQLPTAHDRTSGATDALVAAGFPKANVIAAPQAKTDTENAFNAANIALTKNPQFKHWVAYGLNDEAVLGAVRAAEGRGFKADNMIGIGIGGSDSALSEFKKPQPTGFYGTVIISPKRHGEETSDLMYAWITQGKMPPLLTLTTGMLATRANVGMVRTEMGLASK

SEQ ID NO: 3737 - protein, 331 aa, Ralstonia solanacearum
  arabinose ABC transporter substrate-binding protein; Ralstonia; solanacearum GMI1000
MNQQRRGTFRAIAAATVFAIAGGFVHAAEEVKIGFLVKQPEEPWFQDEWRFADQAAKEKGFKLVKIGVPSGGEVLTAIDNLGAQHAQGFVICVPDVKLGPAVVAKARQNNLKLMTVDDRLVDGGGKPIEAVPHMGISATRIGEQVGEAIAQEMKKRGWNPSEVGAIRIAYDQLPTARERTDGAVAALAKAGFPAANVLTSPQAKTDTEAAFNAADITLTKNPRFKHWIAFGLNDEAVLGAVRAAEGHGIKAADIIGVGIGGSQSALNEFAKPEKTGFFGTVLISPKRHGYETSMNMYSWITASKAPEPLILTSGRLMTRENEKAVRQEMGL

SEQ ID NO: 3738 - protein, 507 aa, Pseudomonas savastanoi
  arabinose import ATP-binding protein AraG; Pseudomonas; savastanoi pv savastanoi
MQQAIEQTSINGALRFNGIGKVFPGVKALSDISFEARPGSVHALMGENGAGKSTLLKILGGSYQPNSGTLQIGEQSYQFKSTAESIAAGVAVIHQELHLVPEMTVAENLLLGHMPNRFGLINRGAMYRRAGELLKGLADEIDPRTRLGDLSLGQRQLVEIAKAMSRNAHVIAFDEPTSSLSAREIDRLMAIIVRLRDEGRVILYVSHRMEEIFRVCDAVTVFKDGRFVKTFEQMADLDHDRLVTCMVGRDIQDIYNYRPRQHQGPSLRVTGLLGPGLHEPVSFAVEKGEVLGFFGLVGAGRTELFRLLSGLTRSTAGTLQLDGKPLTLKSPRDSIEAGILLCPEDRKKEGIVPLSSVAENINIGARPRHVNLGCLIQGRWERDNARSQIKSMNVKTPSPEQQIMFLSGGNQQKAILGRWLSMPMKVLLLDEPTRGIDVGAKSEIYEIIHNLAADGIAVIVVSSDLMEVMGISDRILVMSEGAITGELNRDEADESRLLQLALPRTRS

SEQ ID NO: 3739 - protein, 507 aa, Pseudomonas savastanoi; identical to SEQ ID NO: 3738
  arabinose import ATP-binding protein AraG; Pseudomonas; savastanoi pv savastanoi

SEQ ID NO: 3740 - protein, 511 aa, Ralstonia solanacearum
  arabinose import ATP-binding protein AraG; Ralstonia; solanacearum GMI1000
MSAFLEFRGISKVFPGVRALSEVSFGIECGRVHGLLGENGAGKSTLLKILGGDYQPDGGQIAVEGRPVAFPNARAALAAGIAVIHQELQTVPELTVMDNLLLGHLPSRGGFIRQGEAMAWTRAQLARIGVDLDPKARLKHLSIGQRQMVEICKAILRDARVIALDEPTSSLSVRETDILFRLVKDLRAQGRALIYISHRLDEIFALCDGCTIFRDGRKVADFRSMADVTREQLVAQMVGRQIDDIFGYRPRAPGDVRLRVEGLMGPKLAEPASFAVRRGEIVGLFGLVGAGRSELARLVYGADRKTAGTVVLDGEPIRIRAVADAIRQGIVLCPEDRKEEGIIGCRSVSENINISCRRNRRPGWGGFNLFVDDRQEAKTADHYIARLRIKTPHRDQPIRLLSGGNQQKAILARWLAEDGMRVLIIDEPTRGIDVGAKNEIYQVLYELAERGVAVLMISSELPEILGVADRVLVMSEGRIAGELPRAQATEHAVLNLALRPRRDPCVAAQAA

SEQ ID NO: 3741 - protein, 511 aa, Ralstonia solanacearum; identical to SEQ ID NO: 3740
  arabinose import ATP-binding protein AraG; Ralstonia; solanacearum GMI1000

SEQ ID NO: 3742 - protein, 507 aa, Pseudomonas savastanoi; identical to SEQ ID NO: 3738
  arabinose import ATP-binding protein AraG; Pseudomonas; savastanoi pv savastanoi

SEQ ID NO: 3743 - protein, 507 aa, Pseudomonas savastanoi; identical to SEQ ID NO: 3738
  arabinose import ATP-binding protein AraG; Pseudomonas; savastanoi pv savastanoi

SEQ ID NO: 3744 - protein, 511 aa, Ralstonia solanacearum; identical to SEQ ID NO: 3740
  arabinose import ATP-binding protein AraG; Ralstonia; solanacearum GMI1000

SEQ ID NO: 3745 - protein, 496 aa, Pantoea stewartii
  arabinose isomerase; Pantoea; stewartii subsp stewartii DC283
MQQFNVWFVIGTQHLYGAETLRQVEHNARQVVDGLNQEGLPVRLTLKPLVKSPDEALSLCRDASHDQNCIGIITWLHTFSPAKMWIGGLNVLTKPLLQFHTQFNAEIPWDSMDMDFMNLNQTAHGGREFGFIGARMGLQHSVVTGHWPDKHSQQRVANWMRAALAKQASQHLKVARFGDNMREVAVTEGDKVAAQIQFGYAVNGWGVGDLVEVINSVSEGDVNALVDEYESQYRFSDVAAAGGEKRQNVLDAARIELGLKRFLDDEGCKAFTTNFQTLHGMTQLPGLAVQRLMGQGYGFAGEGDWKTAALLRIFKVLAGDRPGGTSFMEDYTYHFSPGNDLVLGSHMLEVCPSIAREEKPLIDVQFLGIGNKADPARLIFSTPAGRAINASVIDMGDRFRLLVNVVDAIEQPKPLPKLPVARALWKAQPSLATASEAWILAGGAHHTVFSQALTLDDMYLYGEMHGIEVLVIDEHTRLQAFKDALRWNDAYYHMKR

SEQ ID NO: 3746 - protein, 499 aa, Pantoea sp.
  arabinose isomerase; Pantoea; sp 9140
MEQSNNYSVWFVIGTQHLYGPETLRQVEQHARQVVEGLNQAGLPMRLELKPLVKSPDEALALCRDANYDKQCAGIITWLHTFSPAKMWIGGLSVLNKPLLQFHTQFNAEIPWDSMDMDFMNLNQTAHGGREFGFIGARMGLQHSVVTGHWKDSASQQRLGNWMRAALAKQASQQLKVARFGDNMREVAVTEGDKVAAQIQFGYSVNGWGVGDLVEVINGVSDGDVNALIDEYESLYRFTDVAASGGEKRQNVLDAARIELGLKRFLEAEGCHAFTTNFQTLHGMTQLPGLAVQRLMGQGYGFAGEGDWKTAALLRIFKVLAGDRKGGTSFMEDYTYHFSPGNDLVLGSHMLEVCPSIAIEEKPLIDVQFLGIGDKADPARMIFSTPAGRAVNASVIDMGDRFRLLVNVVDAIEQPKPLPKLPVARALWKAQPSLATASEAWILGGGAHHTVFSQALTLDDMYLYGEMNDIEVLVIDEHTTLPAFKDALRWNEAYYRLKR

SEQ ID NO: 3747 - protein, 496 aa, Bacillus subtilis
  arabinose isomerase; Bacillus; subtilis BSn5
MLQTKDYEFWFVTGSQHLYGEETLELVDQHAKSICEGLSGVSSRYKITHKPVVTSPETIRELLREAEYSETCAGIITWMHTFSPAKMWIEGLSSYQKPLMHLHTQYNRDIPWGTIDMDFMNSNQSAHGDREYGYINSRMGLSRKVIAGYWDDEEVKKEMSQWMDTAAALNESRHIKVARFGDNMRHVAVTDGDKVGAHIQFGWQVDGYGIGDLVEVMDRITDDEVDTLYAEYDRLYVISEETKRDEAKVASIKEQAKIELGLTAFLEQGGYTAFTTSFEVLHGMKQLPGLAVQRLMEKGYGFAGEGDWKTAALVRMMKIMAKGKRTSFMEDYTYHFEPGNEMILGSHMLEVCPTVALDQPKIEVHPLSIGGKEDPARFVFNGISGSAIQASIVDIGGRFRLVLNEVNGQEIEKDMPNLPVARVLWKPEPSLKTAAEAWILAGGAHHTCLSYELTAEQMLDWAEMAGIESVLISRDTTIHKLKHELKWNEALYRLQK

SEQ ID NO: 3748 - protein, 498 aa, Erwinia sp.
  arabinose isomerase; Erwinia; sp 9145
MSQLKVWFVIGTQHLYGAETLRQVEQHAQQVVDGLNRDGQLPFVLTLKPLVKSPDEALALCRAANHAQDCLGLIAWLHTFSPAKMWIGGLSVLHKPLLQFHTQFNAEIPWDSMDMDFMNLNQTAHGGREFGFISARMRLPHSVITGHWQDKTAQMRIGKWMRAAAAKQASQQLKVARFGDNMREVAVTEGDKVAAQIQFGYAVNGWGVGDLVEVINQVSDGDVNTLIDEYESLYEFTAAAAVNGEKRQNVLDAARIELGITRFLQAEGCMAFTTNFQTLHGMTQLPGLAVQRLMQQGYGFAGEGDWKTAALLHIFKVMATGLPGGTSFMEDYTYHFSPDNELVLGSHMLEVCPSIAKESRPLIDVQFLGIGGKADPARLIFSAPAGRAVNASVIDMGDRFRLLVNVVDAIEQPQPLPKLPVARALWRAQPSLNTASEAWILGGGAHHTVFSQALTVDDMRQYGEMHGIEVLVIDEETTLHGFRDALRWNEAYYRLNQR

SEQ ID NO: 3749 - protein, 499 aa, Pantoea sp.; identical to SEQ ID NO: 3746
  arabinose isomerase; Pantoea; sp 9140

SEQ ID NO: 3750 - protein, 496 aa, Pantoea stewartii; identical to SEQ ID NO: 3745
  arabinose isomerase; Pantoea; stewartii subsp stewartii DC283

SEQ ID NO: 3751 - protein, 498 aa, Erwinia sp.; identical to SEQ ID NO: 3748
  arabinose isomerase; Erwinia; sp 9145

SEQ ID NO: 3752 - protein, 496 aa, Bacillus subtilis; identical to SEQ ID NO: 3747
  arabinose isomerase; Bacillus; subtilis BSn5

SEQ ID NO: 3753 - protein, 464 aa, Bacillus subtilis
  arabinose-proton symporter; Bacillus; subtilis BSn5
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 3754 - protein, 464 aa, Bacillus subtilis; identical to SEQ ID NO: 3753
  arabinose-proton symporter; Bacillus; subtilis BSn5

SEQ ID NO: 3755 - protein, 337 aa, Pseudomonas syringae
  L-arabinose ABC transporter periplasmic L-arabinose-binding protein; Pseudomonas; syringae pv tomato str DC3000
MLSRHGIRSLCCAAVTTAILGMSGVASAAEEVKIGFLVKQAEEPWFQTEWAFAEKAGKEHGFTVLKIAVPDGEKTLSAIDSLAANGAKGFVICPPDVSLGPAIVAKAKALGLKVMAVDDRFVDAKGNFMEDVPYLGMAAFEVGQKQGAAMATEAKNRKWDEGGWKGTYAIINTYNELDTGKKRTDGSVKALEEAGLPKDHILFTAQKTLDVPGSMDATNSALPKLPGDAKNLIIGGMNDNTVLGGVRATASNGFSAKNVIGIGINGTDAIDELKKKESGFFGSMLPSPDKEGYNTALYMYKWVTEGVEPPKYTAMDDVTLITRANFQEVLTKIGLWK

SEQ ID NO: 3756 - protein, 505 aa, Clavibacter michiganensis
  L-arabinose isomerase; Clavibacter; michiganensis subsp michiganensis NCPPB 382
MSRITTSLDHYEVWFLTGSQNLYGEETLQQVAEQSQEIARQLEEASDIPVRVVWKPVLKDSDSIRRMALEANASDGTIGLIAWMHTFSPAKMWIQGLDALQKPFLHLHTQANVALPWSSIDMDFMNLNQAAHGDREFGYIQSRLGVVRKTVVGHVSTESVRASIGTWMRAAAGWAAVHELKVARFGDNMRNVAVTEGDKTEAELKFGVSVNTWGVNDLVARVDAATDAEIDALVDEYETLYDIQPELRRGGERHESLRYGAAIELGLRSFLEEGGFGAFTTSFEDLGGLRQLPGLAVQRLMAEGYGFGAEGDWKTAVLIRAAKVMGSGLPGGASLMEDYTYHLVPGEEKILGAHMLEICPTLTTGRPSLEIHPLGIGGREDPVRLVFDTDPGPAVVVAMSDMRDRFRIVANVVEVVPLDEPLPNLPVARAVWKPAPDLATSAAAWLTAGAAHHTVMSTQVGVEVFEDFAEIARTELLVIDEDTTLKGFTKEVRWNQAYHRLAQGL

SEQ ID NO: 3757 - protein, 501 aa, Serratia proteamaculans
  L-arabinose isomerase; Serratia; proteamaculans 568
MNAFKQREVWFAIGSQHLYGPQTLQQVKAHAEQVVDSLNREAGLPVKLVLKPLVTTPDEITALCRDANYQPQCIGILAWLHTFSPAKMWIAGLSVLHKPLLQFHTQFNAQVPWDSMDMDFMNLNQTAHGGREFGFIGARMRQQHSVIAGHWQDPEAHRRIGQWMRVASAKQAGQQLKVARFGDNMREVAVTDGDKVGAQIQFGYSVNAYGIGDLVSVINEVSRGDVDTLIEEYEASYVLSDAAKINGAKRENLTDAARIELGMKRFLEQGNFQAFTTNFEDLHGMKQLPGLAVQRLMQQGYGFGGEGDWKTAALLRILKVMADGLHGGTSFMEDYTYHFQPGNDLVVGSHMLEVCPSIAREPKPLLDIQPLGIGGKADPARLIFSTPAGPAVNASLIDMGDRFRLLVNQVDTVEQPHPLPKLPVARAIWRAQPTLATAAEAWILAGGAHHTVFSQALDADMLRLYAEMHNIEFLLIDQDTTLPAFKNELRWNEAYYQLNRR

SEQ ID NO: 3758 - protein, 500 aa, Klebsiella pneumoniae
  L-arabinose isomerase; Klebsiella; pneumoniae 342
MTIFDNYEVWFVIGSQHLYGPEALRQVTKHAEHVVNSLNAEAKLPCKLVLKPLGTTPDEITHICRDANYDDKCAGLVVWLHTFSPAKMWINGLTILNKPLLQFHTQYNAALPWDSIDMDFMNLNQTAHGGREFGFIGARMRQQHSVVTGHWQDKEAHQRIGGWMRQAVSKQDTRHLKVCRFGDNMREVAVTDGDKVAAQIKFGFSVNTWAVGDLVQVVNSISDGDISALVDEYESSYRLTPAAQVHGEKRQNVLDAARIELGMKRFLEQGGFHAFTTTFEDLHGLKQLPGLAVQRLMQQGYGFAGEGDWKTAALLRIMKVMSTGLQGGTSFMEDYTYHFDNGNDLVLGSHMLEVCPTIATAEKPILDVQPLGIGGKADPARLIFNTQTGPAIVASLIDLGDRFRLLVNTIETVPTPHDLPKLPVANALWKAQPDLRTASEAWIIAGGAHHTVFSHALNLDDMRQFAELHNIELTVIDNDTRLPSFKDALRWNEVYYSSKR

SEQ ID NO: 3759 - protein, 500 aa, Enterobacter sp.
  L-arabinose isomerase; Enterobacter; sp 638
MTIFNNYEVWFVIGSQHLYGPEALRQVTQHAEHVVNALNAEAKLPCKLVLKPLGTTPDEITHICRDANYDDKCAGMVVWLHTFSPAKMWINGLTILNKPLLQFHTQFNASLPWDSIDMDFMNLNQTAHGGREFGFIGARMRQQHAVVTGHWQDSQAQKRIGSWMRQAVSKQDTRHLKVVRFGDNMREVAVTDGDKVAAQIKFGFSVNTWAVGDLVQVVNEISDGDVSALVDEYESSYRLTAAAQIKGDKRQNVLDAARIELGMKRFLEQGGFHAFTTTFEDLHGLKQLPGLAVQRLMQQGYGFAGEGDWKTAALLRIMKVMSTGLQGGTSFMEDYTYHFENGNDLVLGSHMLEVCPSIAVEEKPILDVQYLGIGGKADPARLIFNTRTGPAINASLIDLGDRFRLLVNCVDTVETPHSLPKLPVANALWKAQPDLPTASEAWIVAGGAHHTVFSHSLDLNDMRQFAELHDIELTVIDNDTRLPAFKDALRWNEVYYGSKR

SEQ ID NO: 3760 - protein, 500 aa, Klebsiella pneumoniae; identical to SEQ ID NO: 3758
  L-arabinose isomerase; Klebsiella; pneumoniae 342

SEQ ID NO: 3761 - protein, 500 aa, Enterobacter sp.; identical to SEQ ID NO: 3759
  L-arabinose isomerase; Enterobacter; sp 638

SEQ ID NO: 3762 - protein, 501 aa, Serratia proteamaculans; identical to SEQ ID NO: 3757
  L-arabinose isomerase; Serratia; proteamaculans 568

SEQ ID NO: 3763 - protein, 505 aa, Clavibacter michiganensis; identical to SEQ ID NO: 3756
  L-arabinose isomerase; Clavibacter; michiganensis subsp michiganensis NCPPB 382

SEQ ID NO: 3764 - protein, 525 aa, Bradyrhizobium japonicum
  L-arabinose transport ATP-binding protein araG; Bradyrhizobium; japonicum semia 5079
MTAMLEMRNVSKSFSGVQALRDVNFSVEAGQIHALVGENGAGKSTLMKVLSGVYPAGSYEGTIVFEGEERRFRDINDSEALGIIIIHQELALIPLMSIAENIFLSHPPSKFGVIDRDEVYRRTRELLAQVGLKESPDTLITDLGVGKQQLVEIAKALSKRVRMLILDEPTASLNEADSAALLERLMAFREQGIGSILISHKLNEVAKVADHITVLRDGRTVDSIDCRSEPIQEDRIIRSMVNRDLAHRFPERSAKIGEPVLTVENWSVYHPIHPERQVIKNVNFGVKRGEVVGIAGLMGAGRTEFAMSLFGRSWGTTISGRIRLEGREIVLPSVAAAIDAGLAYVTEDRKQLGLILADDVRKNITLASLDQVAPGRVIDDIAELKVASDYRNRMRIRCSDVYQETGQLSGGNQQKVVLSKWLMTDPKVLILDEPTRGIDVGAKYEIYCIINELAEAGRGVVVISSEMPELLGICDRICVMNDGAFVGEFKGTEATQEKIMRAIMRNERSNGNGVPEAAEMGGLQP

SEQ ID NO: 3765 - protein, 525 aa, Bradyrhizobium japonicum; identical to SEQ ID NO: 3764
  L-arabinose transport ATP-binding protein araG; Bradyrhizobium; japonicum semia 5079

SEQ ID NO: 3766 - protein, 525 aa, Bradyrhizobium japonicum; identical to SEQ ID NO: 3764
  L-arabinose transport ATP-binding protein araG; Bradyrhizobium; japonicum semia 5079

SEQ ID NO: 3767 - protein, 507 aa, Pseudomonas syringae
  L-arabinose transporter ATP-binding protein; Pseudomonas; syringae pv tomato str DC3000
MQQAIEQTATGGALRFNGICKVFPGVKALSDISFEARPGSVHALMGENGAGKSTLLKILGGSYQPNSGTLQIGEHSYQFKSTAESIAAGVAVIHQELHLVPEMTVAENLLLGHMPNRFGLINRGAMYRRAGELLKGLADEIDPRTRLGDLSLGQRQLVEIAKAMSRNAHVIAFDEPTSSLSAREIDRLMAIIVRLRDEGRVILYVSHRMEEIFRVCDAVTVFKDGRFVKTFEQMADLDHDRLVTCMVGRDIQDIYNYRPRQHQGPSLRVTGLLGLGLQEPVSFAVQKGEVLGFFGLVGAGRTELFRILSGLTRSTAGSLQLDGQPLTLKSPRDAIAAGVLLCPEDRKKEGIVPLSSVAENINIGARPRHVNLGCLIQGGWERDNARAQIKSMNVKTPSPEQQIMFLSGGNQQKAILGRWLSMPMKVLLLDEPTRGIDVGAKSEIYEIIHTLAADGIAVIVVSSDLMEVMGISDRILVMSEGAITGELNRDEADESRLLQLALPRTRG

SEQ ID NO: 3768 - protein, 507 aa, Pseudomonas syringae; identical to SEQ ID NO: 3767
  L-arabinose transporter ATP-binding protein; Pseudomonas; syringae pv tomato str DC3000

SEQ ID NO: 3769 - protein, 507 aa, Erwinia sp.
  L-arabinose transporter ATP-binding protein; Erwinia; sp 9145
MSMQSAYLSFRGISKTFPGVKALSDISFDCAAGQIHALMGENGAGKSTLLKILSGSYQPTSGEIVLRGEPVRFTHTTAALDAGVAIIYQELHLIPEMSVAENIYLGQLPQRGGLVNRSLLRYEAGEQLKNLGMDIDPDTPLKALSLGQWQMVEIAKALARNAKVIAFDEPTSSLSAREIEHLFRVIRQLRDHGRVVLYVSHRMEEIFALSDAITVFKDGRYVRTFNDVATTSHDDLVQAMVGREIGDIYGYSPRPIGEVRLALNDVQAKGVRKPISLSVRAGEIVGLFGLVGAGRSELMKGLFGATRLTGGELRLDGQPLTIREPGDAIRAGILLCPEDRKADGIIPVHSVRDNINISARRNNVSAGCLIDNKWEDQNAASHIRSLNIKTPSADQLIMHLSGGNQQKAILGRWLSEEMKVILLDEPTRGIDVGAKNEIYSLIYALAEKGIAVLFASSDLPEVMGLADRIVVMREGAIAGELSHDQATEALTLGLAMPKTTQRAAVVA

SEQ ID NO: 3770 - protein, 512 aa, Burkholderia gladioli
  L-arabinose transporter ATP-binding protein; Burkholderia; gladioli UCD-UG CHAPALOTE
MSDTLDTLERSPEPGGAPAAWLELDGIGMSFPGVRALDGVSLSVRAGEVHGLMGENGAGKSTLLKVLSGVNQPQQGRLRLGGVEQRFAGTRAAIDAGVAIIYQELHLVPELTVADNLLLGQLPNRFGVLDERGLVRRATEALQRLGERIDPRTPVKELSIGQRQMIEIGKALMRDARVIAFDEPTSSLSARETENLFRIIDALRADGRAIIYVTHRMDEVYTLCDRVTVFRDGRHIETFESVAELDRNRLIAAMVGRSIADVYGYRPREAGEVLLEAKQLLGPGLAEPISFAARRGEILGFFGLVGAGRSELMKLIYGATRASAGHVELAGRRVAFASPRDAVRAGVALCPEDRKQEGIVAIASVADNLNISARRHFSPARFLLDEKRERTLARDYIEKLAIKTRDGDTAIGTLSGGNQQKVILSRWLAERIEVFLMDEPTRGIDVGARAEIYALLYGLAEAGRTVLMVSSDLAEVIGVADRIVVMREGRIAGIVPKAEATPDQLIKLALPR

SEQ ID NO: 3771 - protein, 512 aa, Burkholderia gladioli; identical to SEQ ID NO: 3770
  L-arabinose transporter ATP-binding protein; Burkholderia; gladioli UCD-UG CHAPALOTE

SEQ ID NO: 3772 - protein, 506 aa, Pantoea sp.
  L-arabinose transporter ATP-binding protein; Pantoea; sp 9140
MNTDSAFLSFHGISKTFPGVKALQDISFDCRGGEVHALMGENGAGKSTLLKILSGSYQPSGGEIRIKGKPMSFQRTTDALDAGVAIIYQELHLVPEMSVAENIYLGQIPHKHGLVNRKLMRFEAGLQLKNLGMDIDPDMPLKYLSLGQWQMVEIAKALARNARIIAFDEPTSSLSAREIDNLFRVIRQLREEGRVVLYVSHRMEEIFALSDAITVFKDGRYVRTFTDMANTHHDDLVQAMVGRNLGDIYGYSPRAKGDVRLELDKVEAKGVRTPISLKVHAGEIVGLFGLVGAGRSELLKGLFGGTRLRGGQVILDGKPLPLREPIDAIRAGIMLCPEDRKAEGIIPVHSVRDNINISARRHNLTAGCLIKNGWENKNADSHIRSLNIKTPSADQLIMNLSGGNQQKAILGRWLSEDMKVILLDEPTRGIDVGAKHEIYNLIYQLANRGIAVLFASSDLPEVMGLADRIVVMREGAIAGELLHDDATEQQTLSLAMPKTTQAAAVA

SEQ ID NO: 3773 - protein, 503 aa, Burkholderia gladioli
  L-arabinose transporter ATP-binding protein; Burkholderia; gladioli UCD-UG CHAPALOTE
MAAVLRFDNIGKVFPGVRALDGISFDVHGGQVHGLMGENGAGKSTLLKILGGEYQPDSGSVLVDGQPVRFASAAASIGAGIAVIHQELQYVPDLTVAENLLLGRLPNALGWVRKGDARRHVRERLQAMGVDLDPQAKLRKLSIAQRQMVEICKALMRNARVIALDEPTSSLSHRETEVLFKLVEDLRAEGRALIYISHRMDEIYRLCDACTIFRDGRRIASHAVLAEVPREQLVSQMVGREINDIYHYRPRPLGQTRLEVKALAGDALKAPADFSVRAGEIVGFFGLVGAGRSELMRVIYGADRKRGGALVLDGKPIEIRRTGDAIRHGIVLCPEDRKEEGIVAMATVAENINISCRRHSLRAGMFLNGRKEAETAERFIKLLKIKTPSRRQKIRFLSGGNQQKAILSRWLAEPDLKVVILDEPTRGIDVGAKNEIYQVIYELAERGCAIVMVSSELPEVLGVSDRIVVMREGRIAGEVTREGANEQVVLNLALPQGPAEQAA

SEQ ID NO: 3774 - protein, 510 aa, Luteibacter sp.
  L-arabinose transporter ATP-binding protein; Luteibacter; sp 9145
MSDTPRLEFRHIGKTFPGVRALGDVGFAVRAGTVHGLLGENGAGKSTMMKILGGEYIPDEGEVAIDGQVMHFRKAADAIDAGVAVIHQELQYVPELSVMENLLLGRLPTRFGLVDRRKALAWTRERLDALGVDLDPRAKLRQLSIGQRQMVEIVKAILRDAKILALDEPTSSLSHRETEVLFRLVNDLRAQGKAMIYISHRLDEIFELCDAATIFRDGRKVADFDTLEGVTRDQLVQRMVGREISDIFGYRHRAHGKVRLDVKAVTGRAVQLPVSFEVKAGEIVGFFGLVGAGRSEVMRVIYGADRRTAGEVTVDGRAVKPSHVRDAIRHGLVFCPEDRKEDGIIGVRSVSENINISARRNHLTAGLFVNDRNEARTADTFIDRLRIRTPHRRQEIRLLSGGNQQKAVLSRWLAEKDLRVLIVDEPTRGIDVGAKNEIYNVLYELADRGVAVVMISSELPEVLGVSDRVVTMCRGRITAQFDRAQANEENVLAAALNEGASAIPTRNVSP

SEQ ID NO: 3775 - protein, 510 aa, Luteibacter sp.; identical to SEQ ID NO: 3774
  L-arabinose transporter ATP-binding protein; Luteibacter; sp 9143

SEQ ID NO: 3776 - protein, 510 aa, Luteibacter sp.; identical to SEQ ID NO: 3774
  L-arabinose transporter ATP-binding protein; Luteibacter; sp 9133

SEQ ID NO: 3777 - protein, 522 aa, Burkholderia sp.
  L-arabinose transporter ATP-binding protein; Burkholderia; sp 9120
MTASPSESHLGETALPTQAPSPATAFASSRPYLRLDGITVRFPGVLALDQVSLEVRRGEVHGLMGENGAGKSTLLKVLSGVNQPAAGTLSLDGVEQQFTTTKAAIAAGVAIIYQELHLVPELTVAENLMLGALPNRFGVLDEKALVARAVHELERLGEKIDPSQQVKNLSIGQRQMIEIGKALMRDARVIAFDEPTSSLSSRETTQLFRIIRALKAEGRAIIYVTHRMDEVYELCDRVTVFRDGRRIDTFDAGEGLDRDRLISCMVGRSIADVYGYRSRELGDVQLDVKGLMGRGLREPASFSARRGEIVGFFGLVGAGRSELMKLIYGAVKPTAGDITLKGKAVRFATPRDAVRAGVALCPEDRKQEGIVSIASVSDNLNISCRRHFSRFNVLNGRKEAQTAKTFIGKLAIKTRNGDTPIGTLSGGNQQKVILSRWLAEEIDVFLMDEPTRGIDVGARSEIYGLLYGLAEAGRTVIVVSSDLAEVIGVADRVIVMKEGRIVGDLPKAQATPDALIKLALPR

SEQ ID NO: 3778 - protein, 512 aa, Burkholderia sp.
  L-arabinose transporter ATP-binding protein; Burkholderia; sp 9120
MSATLRFDNIGKVFPGVRALDGVSFDVNVGQVHGLMGENGAGKSTLLKILGGEYQPDSGRVMIDGNEVRFTSAASSIAAGIAVIHQELQYVPDLTVAENLLLGQLPNSLGWVNKREAKRFVRERLEAMGVALDPNAKLRKLSIAQRQMVEICKALLRNARVIALDEPTSSLSHRETEVLFKLVRDLRADNRAMIYISHRMDEIYELCDACTIFRDGRKIASHPTLEGVTRDTIVSEMVGREISDIYNYSARPLGEVRFAAKAIEGHALAQPASFEVRRGEIVGFFGLVGAGRSELMHLVYGADHRKAGEIVLDGKPIKVRSAGEAIRHGIVLCPEDRKEEGIVAMATVSENINISCRRHYLRAGMFLDRKKEAETADRFIKLLKIKTPSRRQKIRFLSGGNQQKAILSRWLAEPDLKVVILDEPTRGIDVGAKHEIYNVIYQLAERGCAIVMISSELPEVLGVSDRIVVMRQGRISGELLRKDASEQTVLSLALPQSSTALPGTQTAAQQAA

SEQ ID NO: 3779 - protein, 507 aa, Erwinia sp.; identical to SEQ ID NO: 3769
  L-arabinose transporter ATP-binding protein; Erwinia; sp 9145

SEQ ID NO: 3780 - protein, 506 aa, Pantoea sp.; identical to SEQ ID NO: 3772
  L-arabinose transporter ATP-binding protein; Pantoea; sp 9140

SEQ ID NO: 3781 - protein, 512 aa, Burkholderia gladioli; identical to SEQ ID NO: 3770
  L-arabinose transporter ATP-binding protein; Burkholderia; gladioli UCD-UG CHAPALOTE

SEQ ID NO: 3782 - protein, 510 aa, Luteibacter sp.; identical to SEQ ID NO: 3774
  L-arabinose transporter ATP-binding protein; Luteibacter; sp 9145

SEQ ID NO: 3783 - protein, 510 aa, Luteibacter sp.; identical to SEQ ID NO: 3774
  L-arabinose transporter ATP-binding protein; Luteibacter; sp 9143

SEQ ID NO: 3784 - protein, 510 aa, Luteibacter sp.; identical to SEQ ID NO: 3774
  L-arabinose transporter ATP-binding protein; Luteibacter; sp 9133

SEQ ID NO: 3785 - protein, 507 aa, Pseudomonas syringae; identical to SEQ ID NO: 3767
  L-arabinose transporter ATP-binding protein; Pseudomonas; syringae pv tomato str DC3000

SEQ ID NO: 3786 - protein, 512 aa, Burkholderia sp.; identical to SEQ ID NO: 3778
  L-arabinose transporter ATP-binding protein; Burkholderia; sp 9120

SEQ ID NO: 3787 - protein, 522 aa, Burkholderia sp.; identical to SEQ ID NO: 3777
  L-arabinose transporter ATP-binding protein; Burkholderia; sp 9120

SEQ ID NO: 3788 - protein, 503 aa, Burkholderia gladioli; identical to SEQ ID NO: 3773
  L-arabinose transporter ATP-binding protein; Burkholderia; gladioli UCD-UG CHAPALOTE

SEQ ID NO: 3789 - protein, 506 aa, Pantoea sp.; identical to SEQ ID NO: 3772
  L-arabinose transporter ATP-binding protein; Pantoea; sp 9140

SEQ ID NO: 3790 - protein, 507 aa, Erwinia sp.; identical to SEQ ID NO: 3769
  L-arabinose transporter ATP-binding protein; Erwinia; sp 9145

SEQ ID NO: 3791 - protein, 507 aa, Pseudomonas syringae; identical to SEQ ID NO: 3767
  L-arabinose transporter ATP-binding protein; Pseudomonas; syringae pv tomato str DC3000

SEQ ID NO: 3792 - protein, 512 aa, Burkholderia gladioli; identical to SEQ ID NO: 3770
  L-arabinose transporter ATP-binding protein; Burkholderia; gladioli UCD-UG CHAPALOTE

SEQ ID NO: 3793 - protein, 512 aa, Burkholderia sp.; identical to SEQ ID NO: 3778
  L-arabinose transporter ATP-binding protein; Burkholderia; sp 9120

SEQ ID NO: 3794 - protein, 510 aa, Luteibacter sp.; identical to SEQ ID NO: 3774
  L-arabinose transporter ATP-binding protein; Luteibacter; sp 9145

SEQ ID NO: 3795 - protein, 510 aa, Luteibacter sp.; identical to SEQ ID NO: 3774
  L-arabinose transporter ATP-binding protein; Luteibacter; sp 9143

SEQ ID NO: 3796 - protein, 510 aa, Luteibacter sp.; identical to SEQ ID NO: 3774
  L-arabinose transporter ATP-binding protein; Luteibacter; sp 9133

SEQ ID NO: 3797 - protein, 503 aa, Burkholderia gladioli; identical to SEQ ID NO: 3773
  L-arabinose transporter ATP-binding protein; Burkholderia; gladioli UCD-UG CHAPALOTE

SEQ ID NO: 3798 - protein, 522 aa, Burkholderia sp.; identical to SEQ ID NO: 3777
  L-arabinose transporter ATP-binding protein; Burkholderia; sp 9120

SEQ ID NO: 3799 - protein, 508 aa, Sinorhizobium meliloti
  L-arabinose transporter ATP-binding protein (plasmid); Sinorhizobium; meliloti 1021
MQDFLEFQSISKGYPGVQALSEVSFSVRKGAVHGLMGENGAGKSTLIRVLSGDQAADTGEIRINGEPQHYRSVRDAFNAGVIVIHQELQLVPELTVAENLWLGRFPGKAGVIDRRQLIRVVSDRLAEIGIDVDPEAKVASLSIGERQMVEIAKAVMTDARVIALDEPTSSLSSRESEILFALIDRLRSNGTVILYVSHRLDEIFRLCNSLTVLRDGRLAAHHPDISKVGREQIIAEMVGREISNIWGWRARTLGAARLTVERVSGANLPQPISFTVRAGEILGFFGLIGAGRSEMARLVYGADRRRQGKVLVDGLAVPADSPRLSIRAGVVLCPEDRKFDGIVQGRSIEENMAISSRRHFSPFGVVDKGKEAELAERFIAKLRVRTPSRHQDIVNLSGGNQQKVILGRWLSEEGVKVLLIDEPTRGIDVGAKSEIYEILYELAAQGMAIVVISSELPEVMGIADRILVMCEGRIAAEIDRSDFDEHRILAAALPDASATTATLPEQVS

SEQ ID NO: 3800 - protein, 508 aa, Sinorhizobium meliloti; identical to SEQ ID NO: 3799
  L-arabinose transporter ATP-binding protein (plasmid); Sinorhizobium; meliloti 1021

SEQ ID NO: 3801 - protein, 508 aa, Sinorhizobium meliloti; identical to SEQ ID NO: 3799
  L-arabinose transporter ATP-binding protein (plasmid); Sinorhizobium; meliloti 1021

SEQ ID NO: 3802 - protein, 311 aa, Luteibacter sp.
  L-arabinose transporter permease; Luteibacter; sp 9145
MLWQAIDDYSLIGIFIVLFGVLSVTVQYFFSWDNIVGLALSVSQIGMVACTMMFCLASRDFDLSVGSTVAFAGVFCAIVSNATGSVTLGIGASLLAGAFIGFINGAVIAKLKINALITTLATMEIVRGLAFIASSGQAVGVTSEAFFTLGSAELFGLPVPVWVTLGCFVLFGVLLNKTIYGRNTLAIGGNPDAARLAGVPVDRVRILIFLIQGLVAALAGIILASRMTSGQPNAGEGFELNVISACVLGGVSLMGGRASISGVLVGVLIMGTVQNAMSLMNIDAFYQYLVRGTILLIAVLVDQLKNRRQAR

SEQ ID NO: 3803 - protein, 311 aa, Luteibacter sp.; identical to SEQ ID NO: 3802
  L-arabinose transporter permease; Luteibacter; sp 9143

SEQ ID NO: 3804 - protein, 311 aa, Luteibacter sp.; identical to SEQ ID NO: 3802
  L-arabinose transporter permease; Luteibacter; sp 9133

SEQ ID NO: 3805 - protein, 327 aa, Erwinia sp.
  L-arabinose transporter permease; Erwinia; sp 9145
MSTSTTTPAAPSRHRFNPGRIWDNFGMLVVFAVLFIGCTVFVPNFGTLINMKGLGLAMSMSGMVACGMLFCLASGDFDLSVASVIACAGVTTAVVINMTESLWIGIAAGLLLGVACGFVNGFVIARLKINALITTLATMQIVRGLAYIFSDGKAVGIEDERFFALGYTNWLGVPAPVWLTLATMVIFGFLLNRTTFGRNTLAIGGNEEAARLAGVPVVRTRIIIFILSGLVSAAAGIILASRMTSGQPMTSLGYELIVISACVLGGVSLKGGIGKISYVVAGVLILGTVENAMNLLNISPFSQYVVRGLILLAAVIFDRYKQKAKTA

SEQ ID NO: 3806 - protein, 334 aa, Burkholderia gladioli
  L-arabinose transporter permease; Burkholderia; gladioli UCD-UG CHAPALOTE
MNQAMPKGTPASNDTAPITPSRARMWDMINKSGIVVVFVVLFAVLSATVPDFLTVRNIQGLLLSVTLIGSIAVTMMFVLALGEVDLSVASIVAFSGVVASTVITASHSVLLGVAAGILAGGAVGLVNGVLIARFRINSLIATLAMMEAVRGLAFLTSNGDAVMISEERFFELGSGAFLGISFPIWSNIVGFVVFGFLLKKTVFGKNVLAVGGNSEAALLAGLPVTRIKVAVFVLQGLVTGFAGVMLASRMSLGDPKTSVGLELGVISACVLGGVSLTGGVATIAGVLVGVLIMGAVQDAMSLMNVPTFYQYLIRGGILLLAVLFDQFRRSKRAV

SEQ ID NO: 3807 - protein, 334 aa, Burkholderia sp.
  L-arabinose transporter permease; Burkholderia; sp 9120
MQTPSTDTSTAPVVASGLSARAARTWDLINKSGIVMVFVILFAVLSFTVPDFLSSRNIQGLLLSVTLIGSISVTMMFVLALGEVDLSVASIVAFAGVVASTLITATHSVTLGIAAGVLAGGAVGLVNGVLVARFKINSLIVTLAMMEVVRGLAYITSNGDAVMISEERFFDLGGGAFLGISYPIWSNIVGFVLFGFLLKKTVFGKNVLAVGGNSEAALLAGLPVTRIKITVFVLQGLVTGFAGVMLASRMSLGDPKTSVGLELGVISACVLGGVSLTGGVATISGVLVGVLIMGSVQDAMSLMNVPTFYQYLIRGGILLLAVLFDQFRRSKRVH

SEQ ID NO: 3808 - protein, 338 aa, Burkholderia gladioli
  L-arabinose transporter permease; Burkholderia; gladioli UCD-UG CHAPALOTE
MQARENLTQAAAKTAAEALIPQKNDKQKWWQQVTDYSLIVIFAVMFVTMSVTVDHFFSIDNMLGLALSISQIGMVACTMMFCLASRDFDLSIGSTVAFSGVLCAMVLNATDNTFIAIVAAIAAGAAIGFVNGAVIAYLRINALITTLATMEIVRGLGFIVSHGQAVGVSSDTFIALGGLSLFGVSLPIWVTLLCFIVFGVMLNQTVYGRNTLAIGGNPEASRLAGINVERTRVWIFLVQGAVTALAGVILASRITSGQPNAAEGFELNVISACVLGGVSLLGGRATISGVVIGVLIMGTVENVMNLLNIDAFYQYLVRGAILLAAVLLDQLKNRGSRD

SEQ ID NO: 3809 - protein, 338 aa, Burkholderia sp.
  L-arabinose transporter permease; Burkholderia; sp 9120
MQARENLAQQAVKGAADALIPQTTDKTKWWQHVTEYSLIVIFVVMFVTMSLTVDHFFSIENMLGLALSISQIGMVACTMMFCLASRDFDLSVGSTVAFAGVLCAMVLNATGNTFIAIIAAVAAGAVIGFVNGAVIAYLRINALITTLATMEIVRGFGFIVSHGQAVGVSSETFIALGGLSFFGVSLPIWVTLLCFIVFGVMLNQTVYGRNTLAIGGNPEASRLAGINVERTRVYIFLIQGAVTALAGVILASRITSGQPNAAEGFELNVISACVLGGVSLLGGRATISGVVIGVLIMGTVENVMNLMNIDAFYQYLVRGAILLAAVLLDQLKNRGSRD

SEQ ID NO: 3810 - protein, 317 aa, Sinorhizobium meliloti
  L-arabinose transporter permease (plasmid); Sinorhizobium; meliloti 1021
MTTSLKKLLLGEQGLLVIFAAAFVVVALTVPNFLTERNMLGLLQSVVTIGVVACTMMFCLASRDFDLSVGSTVAFSGMVAVMASNATGSIVLGLLAALACGGIVGLANGIVIARFRINALITTLATMQIVRGFALIASDGRAVGINDPVFYQLSLSKFLTVPTPIWVMALFFIVFGFLLNRTVFGKNTLAIGGNPEASRLAGVDVARMRIWIFALQGLVCAVAGVLLASRITSGQPNAATGLELSVISACVLGGVSLAGGRATMTGVVVGVLIMGIAENVMNLLNIQAFYQYVVRGLILLIAVLLDNMRSVAGRPRA

SEQ ID NO: 3811 - protein, 329 aa, Pseudomonas syringae
  L-arabinose transporter permease protein; Pseudomonas; syringae pv tomato str DC3000
MNNKKEVRMSTESSLQAPRQGMNLRRFVDDWVMLLAAVGIFLLCAVFIDNFMSPLNMRGLGLAISTVGIAACTMLFCLASGHFDLSVGSVLACSGVIAGIVIRDTDSVFLGVSAALALGLVVGLINGIVIAKLRINALIATLATMQIVRGLAYIFSNGKAVGVSNEDFFIFGNGQIYGVPVPILITIACFMFFGWLLNYTTYGRNTMAIGGNQEAALLAGVHVDRTKIIIFAVHGLIGALAGVVLASRMTSGQPMIGQGFELTIISACVLGGVSLSGGIGMIRHVIAGVLILAIIENAMNLKNIDTFYQYVIRGTILLLAVIIDRMKRR

SEQ ID NO: 3812 - protein, 309 aa, Mesorhizobium loti
  L-arabinose-binding protein; Mesorhizobium; loti MAFF303099
MAGAASADDIKIGYINKMGEHPWFVAEVGGAKKAAEAAGATFVSQDVQFDSNLTITTFDTMVGDGVKGIAIVVPDKALGPVIAEKAKAAKIPLVAVDDDIYYQDGTQVPYVGMNAYNIGARVGEELAKLYKADGWAGKEVRIASIEDRKADTCMQRNKGAEEAFLKAVPDFKPANILRVPYDNTMVNAIDVMTTTLTANPGVTNWIFYSCNDDGVLGAARALENAGYAADQGMGIGIDGSRACEAFGSGKPSAFRGTMWLNSANHGALAVKILLASIKDGTKLPVQSFTDPEYITAGNFASDYKAKLCH

SEQ ID NO: 3813 - protein, 575 aa, Magnaporthe oryzae
  arabinose-proton symporter; Magnaporthe; oryzae 70-15
MADIQPARPSSGDKAKGAVGGDHVETTSGGPAEKALNEKEALEFARNGGDGEMNSLISSLERELEAEGGLRNGFFDLQFSNTKYFNWMIIAFASMGGMLSGLDQSLISGANLFLPTDLGLSTRELSLVNSAMPLGAVGGALILSPCNEFFGRRMSIMISCFLYTVGAAVCAGSINFGMIVAARVILGMGVGLEGGTVPVYVAETAERRIRGNVVSLYQLNIALGEVLGYAVAAMFLHVEGNWRWILGSSLVFSTIMWGGMLFLPESPRYLMHKRRTLDAFRVWKRIRGTDTPEAREEFFIMKVSVLDEQNAVTETARNKRFPWMDFFTVPRARRALVYANIMILLGQLTGVNAIMYYMSVLMKQIGFDDEKATYMSLVGGGSLLIGTIPACLYMEKFGRRFWANTMLPGFFVGLVIIGASYHIPIDTNTTGAAACYLVGLALYMGFFGCYACLTWVVPSEVYPTYLRSYGMTTSSGLLFLASFVVTYNFSAMQEAMTRTGLTLGFYGGIAVLGWFYQLIFMPETKDKTLEEIDQLFERPTREIVSENMRNLFGRRKSREDAAAAAVSEEKADVYA

We claim:

1. A method for preparing an agricultural seed composition, comprising
selecting at least two endophytes from the following genera: *Cladosporium, Fusarium*, or *Nigrospora* wherein the endophytes are capable of utilizing proline as a sole carbon source; and
manually or mechanically applying a formulation to a plurality of seeds wherein the formulation comprises an effective amount of a synthetic combination of the at least two endophytes heterologously disposed to the plurality of seeds, wherein [the at least two endophytes are selected from the following genera: *Cladosporium, Fusarium*, or *Nigrospora*; wherein the at least two endophytes are capable of utilizing proline as a sole carbon source and] the effective amount increases tolerance to drought in plants grown from the agricultural seed compositions, as compared to isoline plants grown from seeds not contacted with the formulation.

2. The method of claim 1, wherein at least one of the endophytes is additionally capable of utilizing arabinose as a sole carbon source.

3. The method of claim 1, wherein at least one of the endophytes is capable of producing one or more of an auxin, acetoin, or siderophore.

4. The method of claim 1, wherein at least one of the endophytes is additionally capable of utilizing ornithine as a sole carbon source.

5. The method of claim 1, wherein the seeds are monocot plant seeds.

6. The method of claim 5, wherein the monocot plant is selected from the group consisting of corn, wheat, barley and rice.

7. The method of claim 1, wherein the seeds are dicot plant seeds.

8. The method of claim 7, wherein the dicot plant is selected from the group consisting of soybean, canola, cotton, tomato and pepper.

9. The method of claim 1, wherein the seeds are transgenic seeds.

10. The method of claim 1, wherein the at least two endophytes are detectable within a target tissue of an agricultural plant grown from the agricultural seed composition, the target tissue selected from a fruit, seed, leaf, root or portion thereof.

11. The method of claim 1, wherein the at least two endophytes are detected in an amount of at least 100 CFU spores, or more, in the plurality of seeds.

12. The method of claim 1, wherein the effective amount increases the biomass, or yield of a fruit or seed produced by a plant grown from the agricultural seed composition, by at least at least 5%, when compared with the biomass or yield of a fruit or seed of isoline plants grown from seeds not contacted with the formulation.

13. The method of claim 1, wherein the effective amount increases the rate of germination of the agricultural seed composition compared to seeds not contacted with the formulation.

14. The method of claim 1, wherein plants grown from the agricultural seed compositions show at least a 5% increase in root length when tested in a seedling drought assay, as compared to isoline plants grown from seeds not contacted with said formulation, wherein the seedling drought assay is a seed germination paper assay.

15. The method of claim 1, wherein plants grown from the agricultural seed compositions show at least a 20% growth enhancement when tested in a seedling drought assay, as compared to isoline plants grown from seeds not contacted with said formulation, wherein the seedling drought assay is a filter paper growth assay comprising 8% PEG.

16. The method of claim 6, wherein the monocot plant is wheat.

17. The method of claim 8, wherein the dicot plant is soybean.

18. The method of claim 12, wherein the effective amount increases the biomass, or yield of a fruit or seed produced by a plant grown from the agricultural seed composition, by at least at least 10%, when compared with the biomass or yield of a fruit or seed of isoline plants grown from seeds not contacted with the formulation.

19. The method of claim 1, wherein the effective amount increases at least one of root hairs, lateral root number, primary radicle length, and lateral root size in plants grown from the seed compositions compared to isoline plants grown from seeds not contacted with the formulation.

20. The method of claim 1, wherein the effective amount increases shoot length in plants grown from the seed compositions compared to isoline plants grown from seeds not contacted with the formulation.

* * * * *